(12) United States Patent
Merbl et al.

(10) Patent No.: US 9,637,740 B2
(45) Date of Patent: May 2, 2017

(54) CANCER TREATMENT AND IMMUNE SYSTEM REGULATION THROUGH FAT10 PATHWAY INHIBITION

(71) Applicant: President and Fellows of Harvard College, Cambridge, MA (US)

(72) Inventors: Yifat Merbl, Boston, MA (US); Marc W. Kirschner, Newton, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 0 days.

(21) Appl. No.: 14/390,265

(22) PCT Filed: Apr. 2, 2013

(86) PCT No.: PCT/US2013/034950
§ 371 (c)(1),
(2) Date: Oct. 2, 2014

(87) PCT Pub. No.: WO2013/151999
PCT Pub. Date: Oct. 10, 2013

(65) Prior Publication Data
US 2015/0322427 A1     Nov. 12, 2015

Related U.S. Application Data

(60) Provisional application No. 61/619,091, filed on Apr. 2, 2012.

(51) Int. Cl.
| | | |
|---|---|---|
| *A61K 48/00* | (2006.01) | |
| *C07H 21/02* | (2006.01) | |
| *C07H 21/04* | (2006.01) | |
| *C12N 15/113* | (2010.01) | |
| *G01N 33/50* | (2006.01) | |
| *A61K 31/7105* | (2006.01) | |
| *A61K 31/713* | (2006.01) | |
| *G01N 33/68* | (2006.01) | |
| *A01K 67/027* | (2006.01) | |
| *C07K 14/00* | (2006.01) | |

(52) U.S. Cl.
CPC ........ *C12N 15/113* (2013.01); *A01K 67/0276* (2013.01); *A61K 31/713* (2013.01); *A61K 31/7105* (2013.01); *C07K 14/00* (2013.01); *G01N 33/5011* (2013.01); *G01N 33/68* (2013.01); *A01K 2217/075* (2013.01); *A01K 2227/105* (2013.01); *A01K 2267/0331* (2013.01); *C12N 2310/11* (2013.01); *C12N 2310/14* (2013.01); *C12N 2320/30* (2013.01); *G01N 2333/70539* (2013.01); *G01N 2500/02* (2013.01); *G01N 2800/24* (2013.01); *G01N 2800/7028* (2013.01)

(58) Field of Classification Search
CPC ............................ A61K 48/00; C12N 2310/11
See application file for complete search history.

(56) References Cited

U.S. PATENT DOCUMENTS

2010/0215588 A1*   8/2010   Skaliter ................. C12N 15/111
                                                                                                       424/45

* cited by examiner

*Primary Examiner* — Amy Bowman
(74) *Attorney, Agent, or Firm* — Foley Hoag LLP

(57) ABSTRACT

Described herein are methods of inhibiting mitosis, treating cancer and/or treating immune disorders through the use of agents that inhibit FAT 10 and/or the FAT 10 pathway.

7 Claims, 341 Drawing Sheets

Figure 3

| GeneBank | Gene Symbol | Ubiquitin | SUMO2/3 | NEDD8 | FAT10 | SUMO1 | UFM1 | ISG15 |
|---|---|---|---|---|---|---|---|---|
| BC000108 | WWP2 | | | | | | | |
| BC001149 | Utp14a | | | | | | | |
| BC001244 | ASB9 | | | | | | | |
| BC001250 | BCAS3 | | | | | | | |
| BC006124 | Impdh2 | | | | | | | |
| BC006456 | Fam21c | | | | | | | |
| BC007852 | Stk25 | | | | | | | |
| BC008656 | SPATA7 | | | | | | | |
| BC010632 | haus6 | | | | | | | |
| BC012266 | Atg12 | | | | | | | |
| BC013155 | CRYZL1 | | | | | | | |
| BC013366 | fermt3 | | | | | | | |
| BC022363 | vps37a | | | | | | | |
| BC023549 | fbf1 | | | | | | | |
| BC025307 | PRKD2 | | | | | | | |
| BC028124 | C17orf46 | | | | | | | |
| BC028244 | E2F8 | | | | | | | |
| BC029112 | SAMSN1 | | | | | | | |
| BC033005 | Cdk17 | | | | | | | |
| BC034036 | kcnj10 | | | | | | | |
| BC035031 | gabpa | | | | | | | |
| BC039244 | NFYA | | | | | | | |
| BC039832 | PPHLN1 | | | | | | | |
| BC041632 | MTMR9L | | | | | | | |
| BC047865 | MAP4K2 | | | | | | | |
| BC048107 | ZNF333 | | | | | | | |
| BC053656 | edil3 | | | | | | | |
| BC064514 | CORO6 | | | | | | | |
| BC065041 | PLB1 | | | | | | | |
| NM_001001936 | Afap1l2 | | | | | | | |
| NM_001551 | C14orf19 | | | | | | | |
| NM_001926 | DEFA6 | | | | | | | |
| NM_002505 | NFYA | | | | | | | |
| NM_002577 | Pak2 | | | | | | | |
| NM_002767 | PRPSAP2 | | | | | | | |
| NM_002870 | RAB13 | | | | | | | |
| NM_002925 | Rgs10 | | | | | | | |
| NM_003616 | sip1 | | | | | | | |
| NM_004235 | Klf4 | | | | | | | |
| NM_004779 | cnot8 | | | | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_005801 | LOC730144 | | | | | | | |
| NM_005803 | flot1 | | | | | | | |
| NM_006324 | cfdp1 | | | | | | | |
| NM_006669 | LILRB1 | | | | | | | |
| NM_006869 | ADAP1 | | | | | | | |
| NM_007006 | NUDT21 | | | | | | | |
| NM_007162 | TFEB | | | | | | | |
| NM_007172 | NUP50 | | | | | | | |
| NM_012145 | dtymk | | | | | | | |
| NM_012241 | SIRT5 | | | | | | | |
| NM_014571 | hey1 | | | | | | | |
| NM_014667 | VGLL4 | | | | | | | |
| NM_015214 | DDHD2 | | | | | | | |
| NM_015927 | TGFB1I1 | | | | | | | |
| NM_016525 | UBAP1 | | | | | | | |
| NM_017724 | lrrfip2 | | | | | | | |
| NM_017855 | odam | | | | | | | |
| NM_018184 | Arl8b | | | | | | | |
| NM_018384 | GIMAP5 | | | | | | | |
| NM_018553 | C17orf85 | | | | | | | |
| NM_018695 | Erbb2ip | | | | | | | |
| NM_020980 | AQP9 | | | | | | | |
| NM_023112 | OTUB2 | | | | | | | |
| NM_024516 | c16orf53 | | | | | | | |
| NM_024692 | CLIP4 | | | | | | | |
| NM_024946 | fam192a | | | | | | | |
| NM_031473 | IFT81 | | | | | | | |
| NM_032567 | SPZ1 | | | | | | | |
| NM_033387 | FAM78A | | | | | | | |
| NM_053283 | dcd | | | | | | | |
| NM_080664 | C14orf126 | | | | | | | |
| NM_133265 | amot | | | | | | | |
| NM_144679 | C17orf56 | | | | | | | |
| NM_153207 | AEBP2 | | | | | | | |
| NM_153645 | NUP50 | | | | | | | |
| NM_173618 | Ino80e | | | | | | | |
| NM_175609 | ARFGAP1 | | | | | | | |
| NM_181503 | EXOSC8 | | | | | | | |
| NM_183060 | Crem | | | | | | | |
| NM_198181 | LOC642346 | | | | | | | |
| NM_198395 | G3BP1 | | | | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_199190 | Larp4 | | | | | | | ■ |
| XM_379498 | XM_379498 | | | | | | | ■ |
| BC000314 | RTN1 | | | | | | ■ | |
| BC000896 | RAB10 | | | | | | ■ | |
| BC002759 | SLC48A1 | | | | | | ■ | |
| BC002921 | PAK4 | | | | | | ■ | |
| BC003065 | Cdk2 | | | | | | ■ | |
| BC003573 | FDFT1 | | | | | | ■ | |
| BC004233 | Ttyh2 | | | | | | ■ | |
| BC004932 | TMEM204 | | | | | | ■ | |
| BC005072 | BC005072 | | | | | | ■ | |
| BC005220 | CCT8P1 | | | | | | ■ | |
| BC005233 | PNLIPRP1 | | | | | | ■ | |
| BC005305 | Col4a6 | | | | | | ■ | |
| BC005830 | ANXA9 | | | | | | ■ | |
| BC005876 | Atp6v0b | | | | | | ■ | |
| BC006195 | ACLY | | | | | | ■ | |
| BC006499 | hras | | | | | | ■ | |
| BC007080 | tmem14b | | | | | | ■ | |
| BC008200 | KRT8P9 | | | | | | ■ | |
| BC009047 | PDE9A | | | | | | ■ | |
| BC009207 | Hic2 | | | | | | ■ | |
| BC009398 | MCM7 | | | | | | ■ | |
| BC009621 | RAG1AP1 | | | | | | ■ | |
| BC009949 | NCALD | | | | | | ■ | |
| BC011400 | c14orf104 | | | | | | ■ | |
| BC012535 | Lrba | | | | | | ■ | |
| BC013572 | Kras | | | | | | ■ | |
| BC013905 | LOC645591 | | | | | | ■ | |
| BC013928 | FTLP2 | | | | | | ■ | |
| BC016327 | NUP62CL | | | | | | ■ | |
| BC016645 | C8orf62 | | | | | | ■ | |
| BC016715 | FTLP2 | | | | | | ■ | |
| BC016857 | FTHL3 | | | | | | ■ | |
| BC017048 | gjb2 | | | | | | ■ | |
| BC017072 | BTBD10 | | | | | | ■ | |
| BC017328 | Agtrap | | | | | | ■ | |
| BC020838 | CLDN20 | | | | | | ■ | |
| BC020898 | TMEM182 | | | | | | ■ | |
| BC021670 | FTLP2 | | | | | | ■ | |
| BC022083 | BC022083 | | | | | | ■ | |
| BC025278 | AIG1 | | | | | | ■ | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| BC026238 | ORM1 | | | | | | ▨ | |
| BC029439 | LOC100130633 | | | | | | ▨ | |
| BC030957 | ank1 | | | | | | ▨ | |
| BC031041 | Iqch | | | | | | ▨ | |
| BC031564 | C11orf75 | | | | | | ▨ | |
| BC032422 | KIR2DL3 | | | | | | ▨ | |
| BC032455 | C20orf160 | | | | | | ▨ | |
| BC033292 | Il20rb | | | | | | ▨ | |
| BC033872 | FCER1G | | | | | | ▨ | |
| BC034236 | LOC284440 | | | | | | ▨ | |
| BC035054 | RAB28 | | | | | | ▨ | |
| BC038934 | Gjb6 | | | | | | ▨ | |
| BC042038 | C3orf46 | | | | | | ▨ | |
| BC046106 | WFDC2 | | | | | | ▨ | |
| BC047733 | TRDMT1 | | | | | | ▨ | |
| BC051366 | LOC100128510 | | | | | | ▨ | |
| BC054021 | pcbd2 | | | | | | ▨ | |
| BC057768 | csh1 | | | | | | ▨ | |
| BC057803 | Hs3st1 | | | | | | ▨ | |
| BC057840 | PSMB5 | | | | | | ▨ | |
| BC057848 | FLJ43315 | | | | | | ▨ | |
| BC058861 | SULT1C4 | | | | | | ▨ | |
| BC059950 | RPL12P6 | | | | | | ▨ | |
| BC060042 | RPL23AP64 | | | | | | ▨ | |
| BC064945 | GORAB | | | | | | ▨ | |
| BC069451 | Paep | | | | | | ▨ | |
| NM_000345 | Snca | | | | | | ▨ | |
| NM_000394 | CRYAA | | | | | | ▨ | |
| NM_000403 | galE | | | | | | ▨ | |
| NM_000666 | ACY1 | | | | | | ▨ | |
| NM_000805 | GAST | | | | | | ▨ | |
| NM_001003799 | TARP | | | | | | ▨ | |
| NM_001006944 | RPS6KA4 | | | | | | ▨ | |
| NM_001007071 | NM_001007071 | | | | | | ▨ | |
| NM_001014831 | PAK4 | | | | | | ▨ | |
| NM_001042599 | Erbb4 | | | | | | ▨ | |
| NM_001106 | ACVR2B | | | | | | ▨ | |
| NM_001177 | arl1 | | | | | | ▨ | |
| NM_001616 | ACVR2A | | | | | | ▨ | |
| NM_001629 | ALOX5AP | | | | | | ▨ | |
| NM_001640 | APEH | | | | | | ▨ | |
| NM_001663 | Arf6 | | | | | | ▨ | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_001667 | arl2 | | | | | | ▨ | |
| NM_001791 | Cdc42 | | | | | | ▨ | |
| NM_001860 | SLC31A2 | | | | | | ▨ | |
| NM_002035 | kdsr | | | | | | ▨ | |
| NM_002149 | hpcal1 | | | | | | ▨ | |
| NM_002346 | Ly6e | | | | | | ▨ | |
| NM_002444 | msn | | | | | | ▨ | |
| NM_002612 | PDK4 | | | | | | ▨ | |
| NM_002620 | PF4V1 | | | | | | ▨ | |
| NM_002625 | pfkfb1 | | | | | | ▨ | |
| NM_002788 | Psma3 | | | | | | ▨ | |
| NM_002854 | Pvalb | | | | | | ▨ | |
| NM_002861 | PCYT2 | | | | | | ▨ | |
| NM_002867 | RAB3B | | | | | | ▨ | |
| NM_002964 | S100A8 | | | | | | ▨ | |
| NM_003168 | SUPT4H1 | | | | | | ▨ | |
| NM_003277 | CLDN5 | | | | | | ▨ | |
| NM_003994 | KITLG | | | | | | ▨ | |
| NM_004074 | COX8A | | | | | | ▨ | |
| NM_004409 | DMPK | | | | | | ▨ | |
| NM_004485 | GNG4 | | | | | | ▨ | |
| NM_004545 | NDUFB1 | | | | | | ▨ | |
| NM_004580 | Rab27a | | | | | | ▨ | |
| NM_004617 | TM4SF4 | | | | | | ▨ | |
| NM_004710 | SYNGR2 | | | | | | ▨ | |
| NM_004753 | Dhrs3 | | | | | | ▨ | |
| NM_004929 | CALB1 | | | | | | ▨ | |
| NM_005205 | Cox6a2 | | | | | | ▨ | |
| NM_005259 | MSTN | | | | | | ▨ | |
| NM_005332 | HBZ | | | | | | ▨ | |
| NM_005737 | Arl4c | | | | | | ▨ | |
| NM_005922 | MAP3K4 | | | | | | ▨ | |
| NM_006002 | Uchl3 | | | | | | ▨ | |
| NM_006512 | SAA4 | | | | | | ▨ | |
| NM_006549 | camkk2 | | | | | | ▨ | |
| NM_006698 | BLCAP | | | | | | ▨ | |
| NM_006830 | Uqcr11 | | | | | | ▨ | |
| NM_006861 | RAB35 | | | | | | ▨ | |
| NM_007022 | CYB561D2 | | | | | | ▨ | |
| NM_009588 | LTB | | | | | | ▨ | |
| NM_012094 | Prdx5 | | | | | | ▨ | |
| NM_012097 | arl5a | | | | | | ▨ | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_012339 | tspan15 | | | | | | ▨ | |
| NM_012456 | TIMM10 | | | | | | ▨ | |
| NM_014051 | TMEM14A | | | | | | ▨ | |
| NM_014183 | DYNLRB1 | | | | | | ▨ | |
| NM_014343 | CLDN15 | | | | | | ▨ | |
| NM_014399 | TSPAN13 | | | | | | ▨ | |
| NM_014437 | slc39a1 | | | | | | ▨ | |
| NM_014805 | EPM2AIP1 | | | | | | ▨ | |
| NM_016025 | METTL9 | | | | | | ▨ | |
| NM_016226 | VPS29 | | | | | | ▨ | |
| NM_016305 | SS18L2 | | | | | | ▨ | |
| NM_016369 | cldn18 | | | | | | ▨ | |
| NM_016462 | TMEM14C | | | | | | ▨ | |
| NM_016467 | ORMDL1 | | | | | | ▨ | |
| NM_016563 | RASL12 | | | | | | ▨ | |
| NM_018394 | ABHD10 | | | | | | ▨ | |
| NM_019087 | ARL15 | | | | | | ▨ | |
| NM_019101 | APOM | | | | | | ▨ | |
| NM_020347 | LZTFL1 | | | | | | ▨ | |
| NM_020384 | CLDN2 | | | | | | ▨ | |
| NM_020422 | TMEM159 | | | | | | ▨ | |
| NM_020525 | il22 | | | | | | ▨ | |
| NM_021210 | TRAPPC1 | | | | | | ▨ | |
| NM_021252 | RAB18 | | | | | | ▨ | |
| NM_021637 | TMEM35 | | | | | | ▨ | |
| NM_021640 | C12orf10 | | | | | | ▨ | |
| NM_021947 | srr | | | | | | ▨ | |
| NM_022121 | PERP | | | | | | ▨ | |
| NM_022568 | Aldh8a1 | | | | | | ▨ | |
| NM_022749 | FAM160B2 | | | | | | ▨ | |
| NM_022977 | Acsl4 | | | | | | ▨ | |
| NM_024314 | NM_024314 | | | | | | ▨ | |
| NM_024613 | plekhf2 | | | | | | ▨ | |
| NM_025125 | C10orf58 | | | | | | ▨ | |
| NM_030981 | RAB1B | | | | | | ▨ | |
| NM_032354 | tmem107 | | | | | | ▨ | |
| NM_032846 | Rab2b | | | | | | ▨ | |
| NM_032901 | C12orf62 | | | | | | ▨ | |
| NM_032988 | NM_032988 | | | | | | ▨ | |
| NM_033348 | Kcnk7 | | | | | | ▨ | |
| NM_052838 | SEPT1 | | | | | | ▨ | |
| NM_054012 | ASS1 | | | | | | ▨ | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_058173 | MUCL1 | | | | | | ▨ | |
| NM_080660 | ZC3HAV1L | | | | | | ▨ | |
| NM_130782 | RGS18 | | | | | | ▨ | |
| NM_130844 | WWOX | | | | | | ▨ | |
| NM_138453 | Rab3c | | | | | | ▨ | |
| NM_138771 | CCDC126 | | | | | | ▨ | |
| NM_139161 | Crb3 | | | | | | ▨ | |
| NM_145251 | STYX | | | | | | ▨ | |
| NM_145303 | OSTCL | | | | | | ▨ | |
| NM_148571 | NM_148571 | | | | | | ▨ | |
| NM_152471 | NM_152471 | | | | | | ▨ | |
| NM_152690 | NM_152690 | | | | | | ▨ | |
| NM_152785 | GCET2 | | | | | | ▨ | |
| NM_153224 | NM_153224 | | | | | | ▨ | |
| NM_153611 | CYBASC3 | | | | | | ▨ | |
| NM_153702 | ELMOD2 | | | | | | ▨ | |
| NM_172341 | psenen | | | | | | ▨ | |
| NM_173605 | KCNRG | | | | | | ▨ | |
| NM_173796 | NM_173796 | | | | | | ▨ | |
| NM_174926 | Tmem136 | | | | | | ▨ | |
| NM_175735 | lyg2 | | | | | | ▨ | |
| NM_178044 | Giyd2 | | | | | | ▨ | |
| NM_178509 | Stxbp4 | | | | | | ▨ | |
| NM_181705 | LYRM7 | | | | | | ▨ | |
| NM_182715 | SYPL1 | | | | | | ▨ | |
| NM_183397 | PXMP4 | | | | | | ▨ | |
| NM_194270 | NM_194270 | | | | | | ▨ | |
| NM_198175 | NME2 | | | | | | ▨ | |
| NM_198325 | NM_198325 | | | | | | ▨ | |
| NM_198490 | LOC100131426 | | | | | | ▨ | |
| NM_201403 | Mobkl2c | | | | | | ▨ | |
| NM_207350 | NM_207350 | | | | | | ▨ | |
| XM_096472 | XM_096472 | | | | | | ▨ | |
| XM_373800 | XM_373800 | | | | | | ▨ | |
| XM_378350 | XM_378350 | | | | | | ▨ | |
| XM_378564 | XM_378564 | | | | | | ▨ | |
| BC008624 | BC008624 | | | | | | ▨ | ▨ |
| BC012609 | SERPINB2 | | | | | | ▨ | ▨ |
| BC017101 | POMZP3 | | | | | | ▨ | ▨ |
| BC018404 | fgf21 | | | | | | ▨ | ▨ |
| BC031469 | LOC554207 | | | | | | ▨ | ▨ |
| BC062423 | C7orf41 | | | | | | ▨ | ▨ |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_001042452 | Mst4 | | | | | | ▨ | ▨ |
| NM_003805 | CRADD | | | | | | ▨ | ▨ |
| NM_004781 | vamp3 | | | | | | ▨ | ▨ |
| NM_018370 | DRAM1 | | | | | | ▨ | ▨ |
| NM_020390 | Eif5a2 | | | | | | ▨ | ▨ |
| NM_030572 | C12orf39 | | | | | | ▨ | ▨ |
| NM_031472 | Trpt1 | | | | | | ▨ | ▨ |
| NM_032014 | mrps24 | | | | | | ▨ | ▨ |
| NM_033360 | Kras | | | | | | ▨ | ▨ |
| NM_173541 | C10orf91 | | | | | | ▨ | ▨ |
| BC002552 | Hmg20b | | | | | ▨ | | |
| BC003132 | nudC | | | | | ▨ | | |
| BC005383 | CETN3 | | | | | ▨ | | |
| BC006083 | TDP1 | | | | | ▨ | | |
| BC006091 | Tssc4 | | | | | ▨ | | |
| BC010047 | PIAS4 | | | | | ▨ | | |
| BC012040 | Depdc6 | | | | | ▨ | | |
| BC012289 | BAT2L1 | | | | | ▨ | | |
| BC012997 | Sulf1 | | | | | ▨ | | |
| BC014299 | C14orf93 | | | | | ▨ | | |
| BC017227 | PDCL | | | | | ▨ | | |
| BC017780 | CYTH4 | | | | | ▨ | | |
| BC018063 | Kctd4 | | | | | ▨ | | |
| BC021174 | SERF1A | | | | | ▨ | | |
| BC029399 | Aldob | | | | | ▨ | | |
| BC032866 | EIF5 | | | | | ▨ | | |
| BC033159 | DNAJC8 | | | | | ▨ | | |
| BC033871 | TRIM74 | | | | | ▨ | | |
| BC050723 | zbtb44 | | | | | ▨ | | |
| BC051031 | c11orf74 | | | | | ▨ | | |
| BC051687 | KLF3 | | | | | ▨ | | |
| BC060828 | arid3a | | | | | ▨ | | |
| BC063666 | CREB3L2 | | | | | ▨ | | |
| BC065738 | Znf483 | | | | | ▨ | | |
| BC066929 | asph | | | | | ▨ | | |
| BC068514 | NKRF | | | | | ▨ | | |
| NM_001005735 | LOC100133012 | | | | | ▨ | | |
| NM_001006943 | Epha8 | | | | | ▨ | | |
| NM_001012979 | TCEAL5 | | | | | ▨ | | |
| NM_001014431 | akt1 | | | | | ▨ | | |
| NM_001269 | SNHG3-RCC1 | | | | | ▨ | | |
| NM_001274 | CHEK1 | | | | | ▨ | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_002591 | PCK1 | | | | | ▓ | | |
| NM_002609 | Pdgfrb | | | | | ▓ | | |
| NM_002737 | Prkca | | | | | ▓ | | |
| NM_002750 | mapk8 | | | | | ▓ | | |
| NM_002827 | ptpn1 | | | | | ▓ | | |
| NM_003221 | TFAP2B | | | | | ▓ | | |
| NM_003280 | tnnc1 | | | | | ▓ | | |
| NM_003295 | TPT1 | | | | | ▓ | | |
| NM_003352 | SUMO1P3 | | | | | ▓ | | |
| NM_003420 | ZNF35 | | | | | ▓ | | |
| NM_003992 | clk3 | | | | | ▓ | | |
| NM_004438 | EPHA4 | | | | | ▓ | | |
| NM_004811 | Lpxn | | | | | ▓ | | |
| NM_004935 | cdk5 | | | | | ▓ | | |
| NM_005146 | sart1 | | | | | ▓ | | |
| NM_005232 | EPHA1 | | | | | ▓ | | |
| NM_005499 | UBA2 | | | | | ▓ | | |
| NM_005526 | hsf1 | | | | | ▓ | | |
| NM_005828 | dcaf7 | | | | | ▓ | | |
| NM_006112 | ppie | | | | | ▓ | | |
| NM_006590 | Usp39 | | | | | ▓ | | |
| NM_006705 | Gadd45g | | | | | ▓ | | |
| NM_007249 | Klf12 | | | | | ▓ | | |
| NM_007285 | GABARAPL2 | | | | | ▓ | | |
| NM_015933 | LOC728416 | | | | | ▓ | | |
| NM_016200 | naa38 | | | | | ▓ | | |
| NM_017572 | MKNK2 | | | | | ▓ | | |
| NM_020931 | KIAA1586 | | | | | ▓ | | |
| NM_021048 | MAGEA10 | | | | | ▓ | | |
| NM_023015 | INTS3 | | | | | ▓ | | |
| NM_023074 | ZNF649 | | | | | ▓ | | |
| NM_031991 | Ptbp1 | | | | | ▓ | | |
| NM_079420 | MYL1 | | | | | ▓ | | |
| NM_145310 | NM_145310 | | | | | ▓ | | |
| NM_177951 | PPM1A | | | | | ▓ | | |
| NM_201564 | NM_201564 | | | | | ▓ | | |
| NM_203457 | ppie | | | | | ▓ | | |
| BC001327 | Ifrd2 | | | | | ▓ | | ▓ |
| BC009486 | LRRC8D | | | | | ▓ | | ▓ |
| BC026345 | ERMN | | | | | ▓ | | ▓ |
| BC030811 | Klf4 | | | | | ▓ | | ▓ |
| NM_001070 | LOC100133673 | | | | | | | ▓ |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_002608 | Pdgfb | | | | | ✓ | | ✓ |
| NM_004440 | EPHA7 | | | | | ✓ | | ✓ |
| NM_014923 | FNDC3A | | | | | ✓ | | ✓ |
| NM_015640 | serbp1 | | | | | ✓ | | ✓ |
| NM_017679 | BCAS3 | | | | | ✓ | | ✓ |
| NM_139169 | TRUB1 | | | | | ✓ | | ✓ |
| NM_152763 | AKNAD1 | | | | | ✓ | | ✓ |
| NM_153498 | Camk1d | | | | | ✓ | | ✓ |
| NM_178151 | DCX | | | | | ✓ | | ✓ |
| BC000479 | akt1 | | | | | ✓ | ✓ | |
| BC031262 | Ctnna1 | | | | | ✓ | ✓ | |
| NM_001033578 | SGK3 | | | | | ✓ | ✓ | |
| NM_004439 | Epha5 | | | | | ✓ | ✓ | |
| NM_004760 | STK17A | | | | | ✓ | ✓ | |
| NM_006807 | CBX1 | | | | | ✓ | ✓ | |
| NM_016655 | gabpb1 | | | | | ✓ | ✓ | |
| NM_024736 | Gsdmd | | | | | ✓ | ✓ | |
| NM_032691 | NM_032691 | | | | | ✓ | ✓ | |
| NM_033141 | MAP3K9 | | | | | ✓ | ✓ | |
| NM_198086 | JUB | | | | | ✓ | ✓ | |
| BC012746 | MESDC2 | | | | | ✓ | ✓ | ✓ |
| BC017504 | Def6 | | | | | ✓ | ✓ | |
| NM_000698 | ALOX5 | | | | | ✓ | ✓ | |
| NM_002822 | twf1 | | | | | ✓ | ✓ | |
| NM_018326 | GIMAP4 | | | | | ✓ | ✓ | ✓ |
| BC000001 | CHID1 | | | | ✓ | | | |
| BC000112 | rdh11 | | | | ✓ | | | |
| BC000633 | ttk | | | | ✓ | | | |
| BC000651 | Slc1a7 | | | | ✓ | | | |
| BC000870 | TIPIN | | | | ✓ | | | |
| BC001408 | gorasp2 | | | | ✓ | | | |
| BC001454 | pck2 | | | | ✓ | | | |
| BC002488 | serbp1 | | | | ✓ | | | |
| BC002897 | ZNF343 | | | | ✓ | | | |
| BC003555 | noc2l | | | | ✓ | | | |
| BC004101 | bin1 | | | | ✓ | | | |
| BC004514 | ARMC9 | | | | ✓ | | | |
| BC005177 | TMEM51 | | | | ✓ | | | |
| BC005286 | EPM2A | | | | ✓ | | | |
| BC006839 | GATA3 | | | | ✓ | | | |
| BC007014 | TNFAIP8 | | | | ✓ | | | |
| BC007015 | Ccne2 | | | | ✓ | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| BC007411 | DIAPH1 | | | | | | | |
| BC007424 | PRPF4 | | | | | | | |
| BC007560 | LASP1 | | | | | | | |
| BC007724 | Bcl2l12 | | | | | | | |
| BC007919 | stard10 | | | | | | | |
| BC007957 | DDRGK1 | | | | | | | |
| BC008765 | sdc1 | | | | | | | |
| BC009012 | PRPSAP1 | | | | | | | |
| BC010128 | TMEM100 | | | | | | | |
| BC010349 | snx7 | | | | | | | |
| BC010467 | BC010467 | | | | | | | |
| BC011014 | FXC1 | | | | | | | |
| BC011250 | MTMR1 | | | | | | | |
| BC011393 | Chn1 | | | | | | | |
| BC011399 | SYK | | | | | | | |
| BC011563 | lat | | | | | | | |
| BC011863 | HELQ | | | | | | | |
| BC011906 | iscU | | | | | | | |
| BC012105 | NVL | | | | | | | |
| BC012611 | eif4e | | | | | | | |
| BC012881 | BC012881 | | | | | | | |
| BC013009 | ZMYM3 | | | | | | | |
| BC013162 | LOC100129085 | | | | | | | |
| BC013294 | PARM1 | | | | | | | |
| BC014949 | dhx58 | | | | | | | |
| BC015056 | Acad10 | | | | | | | |
| BC015202 | CENPT | | | | | | | |
| BC015467 | ZDHHC3 | | | | | | | |
| BC015674 | Trim16 | | | | | | | |
| BC016652 | BMX | | | | | | | |
| BC016730 | HAX1 | | | | | | | |
| BC016854 | C11orf67 | | | | | | | |
| BC017085 | SERINC2 | | | | | | | |
| BC017237 | STX10 | | | | | | | |
| BC017305 | Sirt7 | | | | | | | |
| BC017357 | ZNF765 | | | | | | | |
| BC017371 | ELK3 | | | | | | | |
| BC017769 | LRRTM4 | | | | | | | |
| BC018037 | Wif1 | | | | | | | |
| BC018732 | CYB5R1 | | | | | | | |
| BC018950 | Trap1 | | | | | | | |
| BC020107 | NUP133 | | | | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| BC020517 | SFXN1 | | | | | | | |
| BC020803 | DRG1 | | | | | | | |
| BC021861 | LOC554202 | | | | | | | |
| BC022344 | twf1 | | | | | | | |
| BC023286 | VAMP1 | | | | | | | |
| BC023288 | slc10a7 | | | | | | | |
| BC024013 | DNAJB3 | | | | | | | |
| BC024209 | CENPJ | | | | | | | |
| BC026175 | Atf2 | | | | | | | |
| BC027596 | ppp2r1b | | | | | | | |
| BC028404 | VSTM2A | | | | | | | |
| BC028725 | elmod1 | | | | | | | |
| BC029424 | Gpx8 | | | | | | | |
| BC029541 | LETM2 | | | | | | | |
| BC029886 | Ocln | | | | | | | |
| BC030524 | CLDN19 | | | | | | | |
| BC030537 | lpin1 | | | | | | | |
| BC030805 | Sdc4 | | | | | | | |
| BC030808 | ZFYVE16 | | | | | | | |
| BC030815 | Pik3r1 | | | | | | | |
| BC030950 | PRAC | | | | | | | |
| BC030983 | IGLV2-11 | | | | | | | |
| BC031074 | PARP16 | | | | | | | |
| BC031608 | Rcor3 | | | | | | | |
| BC031695 | DPCD | | | | | | | |
| BC031999 | hsd3b1 | | | | | | | |
| BC032309 | AADAC | | | | | | | |
| BC032708 | tbl1x | | | | | | | |
| BC033529 | UPP2 | | | | | | | |
| BC034014 | FBXL16 | | | | | | | |
| BC034222 | HRASLS5 | | | | | | | |
| BC034692 | Anln | | | | | | | |
| BC035021 | MARCH10 | | | | | | | |
| BC035143 | TIGD1 | | | | | | | |
| BC035217 | ALOX15B | | | | | | | |
| BC035716 | IRF9 | | | | | | | |
| BC035938 | Mog | | | | | | | |
| BC036123 | SMAP1 | | | | | | | |
| BC036319 | PDE4D | | | | | | | |
| BC036422 | MGC42105 | | | | | | | |
| BC036492 | FMNL2 | | | | | | | |
| BC036817 | Fkbp6 | | | | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| BC037219 | SDR16C5 | | | | | | | |
| BC038113 | cmip | | | | | | | |
| BC038394 | ccnl1 | | | | | | | |
| BC039654 | Tbcd | | | | | | | |
| BC039855 | MRAP2 | | | | | | | |
| BC039904 | HDAC4 | | | | | | | |
| BC040036 | c17orf49 | | | | | | | |
| BC040177 | ppm1h | | | | | | | |
| BC040546 | Pcsk2 | | | | | | | |
| BC041164 | SMPD1 | | | | | | | |
| BC041876 | TTBK2 | | | | | | | |
| BC042151 | glyctk | | | | | | | |
| BC043498 | MTFR1 | | | | | | | |
| BC044218 | micB | | | | | | | |
| BC044851 | Vps41 | | | | | | | |
| BC045809 | AQPEP | | | | | | | |
| BC047666 | NAT1 | | | | | | | |
| BC052995 | SAPS2 | | | | | | | |
| BC053320 | Ctbp1 | | | | | | | |
| BC053365 | RPS6KB1 | | | | | | | |
| BC053508 | atl2 | | | | | | | |
| BC053576 | UGT1A7 | | | | | | | |
| BC053594 | PRRT2 | | | | | | | |
| BC053872 | CPNE5 | | | | | | | |
| BC054033 | msrA | | | | | | | |
| BC054892 | Dynlrb2 | | | | | | | |
| BC055096 | ZNF695 | | | | | | | |
| BC056240 | Sprr1b | | | | | | | |
| BC057831 | BC057831 | | | | | | | |
| BC058833 | Spag11a | | | | | | | |
| BC058862 | TSKS | | | | | | | |
| BC060773 | SOX5 | | | | | | | |
| BC060819 | Zeb2 | | | | | | | |
| BC064943 | LETMD1 | | | | | | | |
| BC066974 | EP400NL | | | | | | | |
| BC067445 | dab1 | | | | | | | |
| BC068482 | CLMN | | | | | | | |
| BC069285 | DEFB4A | | | | | | | |
| NM_000245 | MET | | | | | | | |
| NM_000590 | IL9 | | | | | | | |
| NM_000675 | Adora2a | | | | | | | |
| NM_000799 | EPO | | | | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_000953 | PTGDR | | | | | | | |
| NM_000961 | Ptgis | | | | | | | |
| NM_001005339 | Rgs10 | | | | | | | |
| NM_001006634 | arhgap17 | | | | | | | |
| NM_001008896 | C1orf213 | | | | | | | |
| NM_001017980 | Vma21 | | | | | | | |
| NM_001136 | AGER | | | | | | | |
| NM_001142 | AMELX | | | | | | | |
| NM_001277 | CHKA | | | | | | | |
| NM_001290 | LDB2 | | | | | | | |
| NM_001361 | dhodh | | | | | | | |
| NM_001394 | DUSP4 | | | | | | | |
| NM_001686 | ATP5B | | | | | | | |
| NM_001696 | ATP6V1E1 | | | | | | | |
| NM_001959 | Eef1b2 | | | | | | | |
| NM_002177 | IFNW1 | | | | | | | |
| NM_002427 | MMP13 | | | | | | | |
| NM_002835 | PTPN12 | | | | | | | |
| NM_002922 | RGS1 | | | | | | | |
| NM_003073 | SMARCB1 | | | | | | | |
| NM_003099 | SNX1 | | | | | | | |
| NM_003153 | STAT6 | | | | | | | |
| NM_003302 | TRIP6 | | | | | | | |
| NM_003617 | Rgs5 | | | | | | | |
| NM_003792 | EDF1 | | | | | | | |
| NM_004123 | GIP | | | | | | | |
| NM_004167 | CCL14 | | | | | | | |
| NM_004214 | FIBP | | | | | | | |
| NM_004221 | IL32 | | | | | | | |
| NM_004223 | Ube2l6 | | | | | | | |
| NM_004331 | BNIP3L | | | | | | | |
| NM_004457 | ACSL3 | | | | | | | |
| NM_004458 | Acsl4 | | | | | | | |
| NM_004549 | NDUFC2 | | | | | | | |
| NM_004632 | DAP3 | | | | | | | |
| NM_004699 | Fam50a | | | | | | | |
| NM_004798 | kif3b | | | | | | | |
| NM_004869 | VPS4B | | | | | | | |
| NM_004994 | Mmp9 | | | | | | | |
| NM_001181464 | Mad2 | | | | | | | |
| NM_005000 | NDUFA5 | | | | | | | |
| NM_005040 | prcp | | | | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_005103 | fez1 | | | | | | | |
| NM_005109 | OXSR1 | | | | | | | |
| NM_005151 | USP14 | | | | | | | |
| NM_005254 | gabpb1 | | | | | | | |
| NM_005390 | pdhA2 | | | | | | | |
| NM_005513 | GTF2E1 | | | | | | | |
| NM_005525 | HSD11B1 | | | | | | | |
| NM_005613 | RGS4 | | | | | | | |
| NM_005651 | tdo2 | | | | | | | |
| NM_005727 | TSPAN1 | | | | | | | |
| NM_006038 | SPATA2 | | | | | | | |
| NM_006100 | ST3GAL6 | | | | | | | |
| NM_006136 | Capza2 | | | | | | | |
| NM_006184 | NUCB1 | | | | | | | |
| NM_006202 | Pde4a | | | | | | | |
| NM_006214 | phyH | | | | | | | |
| NM_006246 | PPP2R5E | | | | | | | |
| NM_006468 | POLR3C | | | | | | | |
| NM_006480 | RGS14 | | | | | | | |
| NM_006685 | SMR3B | | | | | | | |
| NM_006870 | DSTN | | | | | | | |
| NM_006902 | PRRX1 | | | | | | | |
| NM_007008 | rtn4 | | | | | | | |
| NM_007019 | UBE2C | | | | | | | |
| NM_007173 | prss23 | | | | | | | |
| NM_007256 | SLCO2B1 | | | | | | | |
| NM_012282 | KCNE1L | | | | | | | |
| NM_012395 | cdk14 | | | | | | | |
| NM_012413 | QPCT | | | | | | | |
| NM_012437 | Snapin | | | | | | | |
| NM_013332 | C7orf68 | | | | | | | |
| NM_013410 | AK3L2 | | | | | | | |
| NM_013975 | lig3 | | | | | | | |
| NM_014033 | mettl7a | | | | | | | |
| NM_014035 | SNX24 | | | | | | | |
| NM_014042 | c11orf51 | | | | | | | |
| NM_014045 | LRP10 | | | | | | | |
| NM_014110 | PPP1R8 | | | | | | | |
| NM_014184 | CNIH4 | | | | | | | |
| NM_014303 | PES1 | | | | | | | |
| NM_014408 | trappc3 | | | | | | | |
| NM_014548 | tmod2 | | | | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_014551 | ncaph2 | | | | | | | |
| NM_014891 | LOC645181 | | | | | | | |
| NM_015002 | Fbxo21 | | | | | | | |
| NM_015184 | PLCL2 | | | | | | | |
| NM_015459 | ATL3 | | | | | | | |
| NM_016185 | HN1 | | | | | | | |
| NM_016417 | glrx5 | | | | | | | |
| NM_016508 | Cdkl3 | | | | | | | |
| NM_016630 | Spg21 | | | | | | | |
| NM_016815 | GYPC | | | | | | | |
| NM_017411 | smn2 | | | | | | | |
| NM_017503 | SURF2 | | | | | | | |
| NM_017566 | klhdc4 | | | | | | | |
| NM_017612 | zcchc8 | | | | | | | |
| NM_017704 | ANKRD49 | | | | | | | |
| NM_017830 | ociad1 | | | | | | | |
| NM_017946 | FKBP14 | | | | | | | |
| NM_018070 | SSBP3 | | | | | | | |
| NM_018243 | sept11 | | | | | | | |
| NM_018325 | C9orf72 | | | | | | | |
| NM_018335 | Znf839 | | | | | | | |
| NM_018393 | TCP11L1 | | | | | | | |
| NM_018452 | LOC645100 | | | | | | | |
| NM_019000 | FAM134B | | | | | | | |
| NM_019005 | MIOS | | | | | | | |
| NM_019895 | CLDND1 | | | | | | | |
| NM_020185 | dusp22 | | | | | | | |
| NM_020381 | pdss2 | | | | | | | |
| NM_020473 | Piga | | | | | | | |
| NM_020676 | ABHD6 | | | | | | | |
| NM_022165 | Lin7b | | | | | | | |
| NM_022337 | RAB38 | | | | | | | |
| NM_022573 | TSPY2 | | | | | | | |
| NM_022776 | OSBPL11 | | | | | | | |
| NM_023079 | Ube2z | | | | | | | |
| NM_024718 | C9orf86 | | | | | | | |
| NM_024800 | Nek11 | | | | | | | |
| NM_024966 | SEMA6D | | | | | | | |
| NM_030803 | atg16l1 | | | | | | | |
| NM_031279 | AGXT2L1 | | | | | | | |
| NM_031439 | Sox7 | | | | | | | |
| NM_031899 | Gorasp1 | | | | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_032146 | arl6 | | | | | | | |
| NM_032204 | ASCC2 | | | | | | | |
| NM_032237 | sgk196 | | | | | | | |
| NM_032289 | Psd2 | | | | | | | |
| NM_032368 | Lzic | | | | | | | |
| NM_032448 | Fam120b | | | | | | | |
| NM_032847 | C8orf76 | | | | | | | |
| NM_032855 | HSH2D | | | | | | | |
| NM_032858 | mael | | | | | | | |
| NM_032906 | PIGY | | | | | | | |
| NM_033310 | Kcnk4 | | | | | | | |
| NM_033316 | mfi2 | | | | | | | |
| NM_033421 | SNX21 | | | | | | | |
| NM_033547 | INTS4 | | | | | | | |
| NM_033661 | wdr4 | | | | | | | |
| NM_080387 | CLEC4D | | | | | | | |
| NM_080650 | ATPBD4 | | | | | | | |
| NM_138288 | c14orf147 | | | | | | | |
| NM_138395 | MARS2 | | | | | | | |
| NM_138430 | ADPRHL1 | | | | | | | |
| NM_138480 | NM_138480 | | | | | | | |
| NM_138492 | PRELID2 | | | | | | | |
| NM_139348 | bin1 | | | | | | | |
| NM_145177 | DHRSX | | | | | | | |
| NM_145268 | C7orf45 | | | | | | | |
| NM_145306 | c10orf35 | | | | | | | |
| NM_152259 | c15orf42 | | | | | | | |
| NM_152772 | TCP11L2 | | | | | | | |
| NM_152789 | LOC728153 | | | | | | | |
| NM_153220 | NM_153220 | | | | | | | |
| NM_173475 | DCUN1D3 | | | | | | | |
| NM_173571 | CT47A2 | | | | | | | |
| NM_173850 | SERPINA12 | | | | | | | |
| NM_174912 | FAAH2 | | | | | | | |
| NM_175877 | NM_175877 | | | | | | | |
| NM_177949 | ARMCX2 | | | | | | | |
| NM_177999 | Asb6 | | | | | | | |
| NM_178126 | fam134c | | | | | | | |
| NM_178536 | LCN12 | | | | | | | |
| NM_178588 | PPP2R5C | | | | | | | |
| NM_178859 | Ostbeta | | | | | | | |
| NM_181349 | SMURF1 | | | | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_182487 | OLFML2A | | | | ▓ | | | |
| NM_182494 | NM_182494 | | | | ▓ | | | |
| NM_182553 | cnih2 | | | | ▓ | | | |
| NM_197967 | BID | | | | ▓ | | | |
| NM_198152 | Uts2d | | | | ▓ | | | |
| NM_198197 | NM_198197 | | | | ▓ | | | |
| NM_198276 | TMEM17 | | | | ▓ | | | |
| NM_198489 | CCDC84 | | | | ▓ | | | |
| NM_199054 | MKNK2 | | | | ▓ | | | |
| NM_206824 | VKORC1 | | | | ▓ | | | |
| NM_206909 | PSD3 | | | | ▓ | | | |
| NM_207047 | ENSA | | | | ▓ | | | |
| XM_042301 | XM_042301 | | | | ▓ | | | |
| XM_209489 | LOC285141 | | | | ▓ | | | |
| BC029480 | NCRNA00183 | | | | | | | ▓ |
| BC035636 | APBB1IP | | | | ▓ | | | ▓ |
| BC052805 | epb49 | | | | ▓ | | | ▓ |
| BC065370 | C20orf112 | | | | ▓ | | | ▓ |
| NM_006832 | Fermt2 | | | | ▓ | | | ▓ |
| NM_007045 | FGFR1OP | | | | ▓ | | | ▓ |
| NM_013354 | cnot7 | | | | ▓ | | | ▓ |
| NM_014943 | ZHX2 | | | | ▓ | | | ▓ |
| NM_018990 | SASH3 | | | | ▓ | | | ▓ |
| NM_173192 | Kcnip2 | | | | ▓ | | | ▓ |
| NM_198081 | SCML4 | | | | ▓ | | | ▓ |
| BC005350 | REG1A | | | | ▓ | | ▓ | |
| BC008201 | REEP6 | | | | ▓ | | ▓ | |
| BC018206 | FAM128A | | | | ▓ | | ▓ | |
| BC021701 | c14orf147 | | | | ▓ | | ▓ | |
| BC022357 | C18orf32 | | | | ▓ | | ▓ | |
| BC025787 | ALKBH1 | | | | ▓ | | ▓ | |
| BC032825 | sh3gl2 | | | | ▓ | | ▓ | |
| BC045655 | TMEM97 | | | | ▓ | | ▓ | |
| BC065522 | VEGFA | | | | ▓ | | ▓ | |
| NM_000897 | NM_000897 | | | | ▓ | | ▓ | |
| NM_002624 | PFDN5 | | | | ▓ | | ▓ | |
| NM_003045 | SLC7A1 | | | | ▓ | | ▓ | |
| NM_003063 | Sln | | | | ▓ | | ▓ | |
| NM_006498 | lgals2 | | | | ▓ | | ▓ | |
| NM_014015 | DEXI | | | | ▓ | | ▓ | |
| NM_015646 | Rap1b | | | | ▓ | | ▓ | |
| NM_015973 | GAL | | | | ▓ | | ▓ | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_016069 | TIMM16 | | | | X | | X | |
| NM_016103 | Sar1B | | | | X | | X | |
| NM_016322 | Rab14 | | | | X | | X | |
| NM_020150 | sar1a | | | | X | | X | |
| NM_024312 | GNPTAB | | | | X | | X | |
| NM_025243 | SLC19A3 | | | | X | | X | |
| NM_144492 | CLDN14 | | | | X | | X | |
| NM_152646 | NM_152646 | | | | X | | X | |
| NM_181689 | Nnat | | | | X | | X | |
| NM_182493 | MYLK3 | | | | X | | X | |
| NM_182739 | NDUFB6 | | | | X | | X | |
| NM_201613 | ikbip | | | | X | | X | |
| NM_002498 | NEK3 | | | | | X | | X |
| BC033167 | CABP4 | | | | X | X | | |
| BC036335 | BTBD12 | | | | X | X | | |
| NM_004844 | SH3BP5 | | | | X | | | |
| NM_006591 | pold3 | | | | X | | | |
| NM_182907 | PRDM1 | | | | X | | | |
| NM_005902 | SMAD3 | | | | X | | | X |
| NM_020397 | Camk1d | | | | X | | X | |
| BC000247 | THAP4 | | | X | | | | |
| BC000453 | pcm1 | | | X | | | | |
| BC001132 | ddx54 | | | X | | | | |
| BC002559 | YTHDF2 | | | X | | | | |
| BC003127 | SEPX1 | | | X | | | | |
| BC003403 | rap2c | | | X | | | | |
| BC006104 | RIOK1 | | | X | | | | |
| BC006376 | NMT2 | | | X | | | | |
| BC006423 | AURKA | | | X | | | | |
| BC008365 | TMEM205 | | | X | | | | |
| BC008623 | robo3 | | | X | | | | |
| BC009046 | NEUROD1 | | | X | | | | |
| BC009478 | DCUN1D1 | | | X | | | | |
| BC010697 | RNPC3 | | | X | | | | |
| BC011842 | C4orf43 | | | X | | | | |
| BC013107 | DCAF8 | | | X | | | | |
| BC013957 | Esyt2 | | | X | | | | |
| BC014264 | C19orf33 | | | X | | | | |
| BC015505 | DDX42 | | | X | | | | |
| BC016967 | RPUSD2 | | | X | | | | |
| BC017589 | TPD52L3 | | | X | | | | |
| BC019039 | rgs3 | | | X | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| BC020651 | MRPL35 | | | ▨ | | | | |
| BC021906 | FMNL1 | | | ▨ | | | | |
| BC021983 | LOC399804 | | | ▨ | | | | |
| BC025266 | TASP1 | | | ▨ | | | | |
| BC028425 | Mlc1 | | | ▨ | | | | |
| BC030020 | DDX55 | | | ▨ | | | | |
| BC032852 | MAGEB4 | | | ▨ | | | | |
| BC033088 | lmna | | | ▨ | | | | |
| BC033758 | ADAP2 | | | ▨ | | | | |
| BC033819 | CADM3 | | | ▨ | | | | |
| BC034718 | EPB41L2 | | | ▨ | | | | |
| BC035040 | gramd1c | | | ▨ | | | | |
| BC035601 | WWC3 | | | ▨ | | | | |
| BC035680 | Traj17 | | | ▨ | | | | |
| BC036109 | secisbp2 | | | ▨ | | | | |
| BC036827 | LILRB2 | | | ▨ | | | | |
| BC038406 | C3orf20 | | | ▨ | | | | |
| BC038976 | ARHGAP15 | | | ▨ | | | | |
| BC040946 | CWC15 | | | ▨ | | | | |
| BC042428 | COL23A1 | | | ▨ | | | | |
| BC042625 | luc7l2 | | | ▨ | | | | |
| BC045167 | HARS2 | | | ▨ | | | | |
| BC045641 | GFPT1 | | | ▨ | | | | |
| BC048301 | ZCCHC11 | | | ▨ | | | | |
| BC050434 | arglu1 | | | ▨ | | | | |
| BC050645 | bysl | | | ▨ | | | | |
| BC058032 | C14orf118 | | | ▨ | | | | |
| BC059404 | Bcl6b | | | ▨ | | | | |
| BC059947 | CSAG1 | | | ▨ | | | | |
| BC061514 | MPV17L | | | ▨ | | | | |
| BC067446 | dab1 | | | ▨ | | | | |
| BC067755 | Kctd18 | | | ▨ | | | | |
| NM_000210 | itga6 | | | ▨ | | | | |
| NM_001001660 | LYRM5 | | | ▨ | | | | |
| NM_001207 | BTF3L1 | | | ▨ | | | | |
| NM_002082 | grk6 | | | ▨ | | | | |
| NM_002363 | MAGEB1 | | | ▨ | | | | |
| NM_002364 | MAGEB2 | | | ▨ | | | | |
| NM_002387 | MCC | | | ▨ | | | | |
| NM_002469 | MYF6 | | | ▨ | | | | |
| NM_002690 | polB | | | ▨ | | | | |
| NM_002916 | RfC4 | | | ▨ | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_003313 | TSTA3 | | | | | | | |
| NM_003666 | BLZF1 | | | | | | | |
| NM_003684 | mknk1 | | | | | | | |
| NM_004236 | COPS2 | | | | | | | |
| NM_004645 | COIL | | | | | | | |
| NM_004804 | CIAO1 | | | | | | | |
| NM_004895 | NLRP3 | | | | | | | |
| NM_005019 | pde1a | | | | | | | |
| NM_005174 | Atp5c1 | | | | | | | |
| NM_005697 | SCAMP2 | | | | | | | |
| NM_005710 | PQBP1 | | | | | | | |
| NM_005898 | Caprin1 | | | | | | | |
| NM_006110 | CD2BP2 | | | | | | | |
| NM_006156 | nedd8 | | | | | | | |
| NM_006442 | DRAP1 | | | | | | | |
| NM_006580 | Cldn16 | | | | | | | |
| NM_012113 | CA14 | | | | | | | |
| NM_012369 | OR2F1 | | | | | | | |
| NM_013242 | C16orf80 | | | | | | | |
| NM_014047 | C19orf53 | | | | | | | |
| NM_014268 | MAPRE2 | | | | | | | |
| NM_014665 | LRRC14 | | | | | | | |
| NM_016234 | ACSL5 | | | | | | | |
| NM_016321 | RHCG | | | | | | | |
| NM_017451 | BAIAP2 | | | | | | | |
| NM_018014 | BCL11A | | | | | | | |
| NM_018039 | KDM4D | | | | | | | |
| NM_018276 | NM_018276 | | | | | | | |
| NM_020345 | NKIRAS1 | | | | | | | |
| NM_021627 | SENP2 | | | | | | | |
| NM_021639 | GPBP1L1 | | | | | | | |
| NM_022575 | VPS16 | | | | | | | |
| NM_023938 | C1orf116 | | | | | | | |
| NM_024313 | NOL12 | | | | | | | |
| NM_024506 | glb1l | | | | | | | |
| NM_024779 | PIP4K2C | | | | | | | |
| NM_024790 | CSPP1 | | | | | | | |
| NM_025041 | C3orf36 | | | | | | | |
| NM_030792 | GDPD5 | | | | | | | |
| NM_030903 | OR2W1 | | | | | | | |
| NM_032017 | Stk40 | | | | | | | |
| NM_032091 | PCDHGA11 | | | | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_032704 | TUBA1C | | | ▨ | | | | |
| NM_032726 | PLCD4 | | | ▨ | | | | |
| NM_032728 | PPAPDC3 | | | ▨ | | | | |
| NM_053005 | MOB2 | | | ▨ | | | | |
| NM_078630 | MSL3 | | | ▨ | | | | |
| NM_080390 | TCEAL2 | | | ▨ | | | | |
| NM_080678 | UBE2F | | | ▨ | | | | |
| NM_134323 | TARBP2 | | | ▨ | | | | |
| NM_138412 | RDH13 | | | ▨ | | | | |
| NM_138559 | BCL11A | | | ▨ | | | | |
| NM_138820 | HIGD2A | | | ▨ | | | | |
| NM_139016 | NM_139016 | | | ▨ | | | | |
| NM_139162 | smcr7 | | | ▨ | | | | |
| NM_139168 | SFRS12 | | | ▨ | | | | |
| NM_145271 | ZNF785 | | | ▨ | | | | |
| NM_152715 | tbcel | | | ▨ | | | | |
| NM_152786 | C9orf43 | | | ▨ | | | | |
| NM_170610 | HIST1H2BA | | | ▨ | | | | |
| NM_175887 | PRR15 | | | ▨ | | | | |
| NM_176870 | MT1M | | | ▨ | | | | |
| NM_178014 | TUBBP2 | | | ▨ | | | | |
| NM_178832 | MORN4 | | | ▨ | | | | |
| NM_182534 | NM_182534 | | | ▨ | | | | |
| NM_205848 | SYT6 | | | ▨ | | | | |
| XM_375456 | XM_375456 | | | ▨ | | | | |
| XM_378988 | XM_378988 | | | ▨ | | | | |
| BC014667 | IGHV3-11 | | | ▨ | | | | ▨ |
| BC014991 | mpg | | | ▨ | | | | ▨ |
| BC017865 | Fcgr3a | | | ▨ | | | | ▨ |
| BC024289 | BC024289 | | | ▨ | | | | ▨ |
| BC036723 | Fcgr3a | | | ▨ | | | | ▨ |
| BC042999 | ASXL2 | | | ▨ | | | | ▨ |
| NM_003390 | wee1 | | | ▨ | | | | ▨ |
| NM_003636 | Kcnab2 | | | ▨ | | | | ▨ |
| BC000250 | nme3 | | | ▨ | | | ▨ | |
| BC013120 | PMAIP1 | | | ▨ | | | ▨ | |
| BC056669 | DCUN1D2 | | | ▨ | | | ▨ | |
| NM_001752 | cat | | | ▨ | | | ▨ | |
| NM_002446 | Map3k10 | | | ▨ | | | ▨ | |
| NM_014248 | RBX1 | | | ▨ | | | ▨ | |
| NM_018668 | Vps33B | | | ▨ | | | ▨ | |
| BC006323 | ABCB7 | | | ▨ | | ▨ | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| BC010629 | Odf2 | | | X | | X | | |
| BC015749 | STXBP1 | | | X | | X | | |
| BC022243 | TET3 | | | X | | X | | |
| BC064612 | MLLT6 | | | X | | X | | |
| BC065525 | add2 | | | X | | X | | |
| NM_001004056 | GRK4 | | | X | | X | | |
| NM_001004105 | grk6 | | | X | | X | | |
| NM_006621 | AHCYL1 | | | X | | X | | |
| NM_130439 | MXI1 | | | X | | X | | |
| NM_018158 | SLC4A1AP | | | X | | X | | X |
| NM_006206 | pdgfra | | | X | | X | X | |
| NM_144588 | ZFYVE27 | | | X | | | X | X |
| BC000594 | loxl2 | | | X | X | | | |
| BC000770 | DIDO1 | | | X | X | | | |
| BC001396 | mettl11a | | | X | X | | | |
| BC005974 | Vamp4 | | | X | X | | | |
| BC007019 | Vamp4 | | | X | X | | | |
| BC011234 | SMNDC1 | | | X | X | | | |
| BC011600 | BC011600 | | | X | X | | | |
| BC014924 | KIF2C | | | X | X | | | |
| BC023152 | gyg2 | | | X | X | | | |
| BC034488 | ABCF1 | | | X | X | | | |
| BC036089 | MLLT3 | | | X | X | | | |
| BC050616 | Tssc4 | | | X | X | | | |
| NM_004148 | Ninj1 | | | X | X | | | |
| NM_005565 | lcp2 | | | X | X | | | |
| NM_005735 | Actr1b | | | X | X | | | |
| NM_006403 | Nedd9 | | | X | X | | | |
| NM_015138 | Rtf1 | | | X | X | | | |
| NM_017583 | TRIM44 | | | X | X | | | |
| NM_018032 | LUC7L | | | X | X | | | |
| NM_022474 | mpp5 | | | X | X | | | |
| NM_032883 | TOX2 | | | X | X | | | |
| NM_152376 | Ubxn10 | | | X | X | | | |
| NM_173519 | Clvs1 | | | X | X | | | X |
| BC001048 | CDK16 | | | X | X | | | X |
| BC009967 | scyl1 | | | X | X | | | X |
| BC018722 | aspscr1 | | | X | X | | | X |
| BC022983 | Lnx1 | | | X | X | | | X |
| BC064367 | anks6 | | | X | X | | | X |
| BC056907 | BC056907 | | | X | X | | X | |
| BC000166 | kat5 | | X | | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| BC001121 | Dguok | | | | | | | |
| BC001184 | znf574 | | | | | | | |
| BC001428 | plekhb2 | | | | | | | |
| BC002701 | ATMIN | | | | | | | |
| BC003356 | GBA | | | | | | | |
| BC003360 | DDX18 | | | | | | | |
| BC005153 | rph3al | | | | | | | |
| BC005155 | Arhgef1 | | | | | | | |
| BC005807 | scd | | | | | | | |
| BC007704 | synj2bp | | | | | | | |
| BC007815 | GPN2 | | | | | | | |
| BC008318 | iars | | | | | | | |
| BC008912 | FAM3A | | | | | | | |
| BC008919 | tbc1d9b | | | | | | | |
| BC010061 | mks1 | | | | | | | |
| BC011680 | klhdc4 | | | | | | | |
| BC011857 | IGHV3-11 | | | | | | | |
| BC011892 | COBRA1 | | | | | | | |
| BC012814 | ZFPL1 | | | | | | | |
| BC013424 | armc8 | | | | | | | |
| BC013966 | FAM64A | | | | | | | |
| BC014863 | TPP1 | | | | | | | |
| BC015316 | Ube2q1 | | | | | | | |
| BC015734 | CPNE3 | | | | | | | |
| BC015904 | mRpL10 | | | | | | | |
| BC016841 | RAB34 | | | | | | | |
| BC016964 | MRGPRF | | | | | | | |
| BC017064 | C3orf52 | | | | | | | |
| BC017355 | kpna3 | | | | | | | |
| BC020523 | INTS7 | | | | | | | |
| BC020726 | SCEL | | | | | | | |
| BC021211 | Reps1 | | | | | | | |
| BC021229 | Ept1 | | | | | | | |
| BC022340 | SUMO3 | | | | | | | |
| BC023546 | LIMCH1 | | | | | | | |
| BC024194 | HMGCLL1 | | | | | | | |
| BC028203 | Mier2 | | | | | | | |
| BC029220 | SOX5 | | | | | | | |
| BC030290 | BC030290 | | | | | | | |
| BC032485 | aifm3 | | | | | | | |
| BC033181 | FMNL3 | | | | | | | |
| BC033766 | NDUFV3 | | | | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| BC038504 | Sik1 | | ▓ | | | | | |
| BC038808 | APOBEC3F | | ▓ | | | | | |
| BC040351 | FOXRED2 | | ▓ | | | | | |
| BC050548 | KIF4A | | ▓ | | | | | |
| BC050683 | znf410 | | ▓ | | | | | |
| BC050704 | DCDC2 | | ▓ | | | | | |
| BC051790 | STX17 | | ▓ | | | | | |
| BC052803 | foxp4 | | ▓ | | | | | |
| BC052966 | parg | | ▓ | | | | | |
| BC052984 | xylB | | ▓ | | | | | |
| BC053878 | zap70 | | ▓ | | | | | |
| BC053901 | ZNF280A | | ▓ | | | | | |
| BC057770 | slc27a2 | | ▓ | | | | | |
| BC058005 | GPR1 | | ▓ | | | | | |
| BC058915 | Sec14l2 | | ▓ | | | | | |
| BC062459 | BTNL9 | | ▓ | | | | | |
| BC066353 | LMX1A | | ▓ | | | | | |
| NM_000023 | SGCA | | ▓ | | | | | |
| NM_000477 | alb | | ▓ | | | | | |
| NM_000997 | RPL37 | | ▓ | | | | | |
| NM_001004306 | CCDC144NL | | ▓ | | | | | |
| NM_001674 | atf3 | | ▓ | | | | | |
| NM_001692 | atp6v1b1 | | ▓ | | | | | |
| NM_002300 | ldhb | | ▓ | | | | | |
| NM_002436 | MPP1 | | ▓ | | | | | |
| NM_002462 | mx1 | | ▓ | | | | | |
| NM_002540 | Odf2 | | ▓ | | | | | |
| NM_002694 | NM_002694 | | ▓ | | | | | |
| NM_002739 | PRKCG | | ▓ | | | | | |
| NM_002832 | PTPN7 | | ▓ | | | | | |
| NM_003049 | SLC10A1 | | ▓ | | | | | |
| NM_003463 | ptp4a1 | | ▓ | | | | | |
| NM_003697 | OR5F1 | | ▓ | | | | | |
| NM_003724 | Jrk | | ▓ | | | | | |
| NM_003848 | LOC283398 | | ▓ | | | | | |
| NM_003874 | CD84 | | ▓ | | | | | |
| NM_004170 | SLC1A1 | | ▓ | | | | | |
| NM_004286 | GTPBP1 | | ▓ | | | | | |
| NM_004720 | LPAR2 | | ▓ | | | | | |
| NM_004865 | TBPL1 | | ▓ | | | | | |
| NM_005114 | Hs3st1 | | ▓ | | | | | |
| NM_005465 | Akt3 | | ▓ | | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_006388 | kat5 | | | | | | | |
| NM_006426 | Dpysl4 | | | | | | | |
| NM_006686 | ACTL7B | | | | | | | |
| NM_006695 | RUNDC3A | | | | | | | |
| NM_006899 | IDH3B | | | | | | | |
| NM_006937 | SUMO3 | | | | | | | |
| NM_007054 | Kif3a | | | | | | | |
| NM_012443 | SPAG6 | | | | | | | |
| NM_012459 | LOC100131128 | | | | | | | |
| NM_013323 | Snx11 | | | | | | | |
| NM_013401 | RAB3IL1 | | | | | | | |
| NM_014065 | ASTE1 | | | | | | | |
| NM_014188 | ssu72 | | | | | | | |
| NM_014481 | apex2 | | | | | | | |
| NM_014519 | ZNF232 | | | | | | | |
| NM_014752 | LOC653566 | | | | | | | |
| NM_015963 | THAP4 | | | | | | | |
| NM_016298 | Fbxo40 | | | | | | | |
| NM_016511 | CLEC1A | | | | | | | |
| NM_016520 | C9orf78 | | | | | | | |
| NM_016568 | rxfp3 | | | | | | | |
| NM_016951 | Cklf | | | | | | | |
| NM_020235 | Bbx | | | | | | | |
| NM_020661 | AICDA | | | | | | | |
| NM_021071 | ART4 | | | | | | | |
| NM_022822 | KLC2 | | | | | | | |
| NM_023937 | Mrpl34 | | | | | | | |
| NM_024012 | htr5a | | | | | | | |
| NM_025004 | ccdc15 | | | | | | | |
| NM_030881 | DDX17 | | | | | | | |
| NM_031282 | FCRL4 | | | | | | | |
| NM_032140 | C16orf48 | | | | | | | |
| NM_032786 | ZC3H10 | | | | | | | |
| NM_032831 | Orai2 | | | | | | | |
| NM_033103 | rhpn2 | | | | | | | |
| NM_052845 | MMAB | | | | | | | |
| NM_052913 | TMEM200A | | | | | | | |
| NM_080652 | Tmem41a | | | | | | | |
| NM_080873 | Asb11 | | | | | | | |
| NM_133480 | TADA3 | | | | | | | |
| NM_133635 | POFUT2 | | | | | | | |
| NM_138390 | TMEM169 | | | | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_138775 | Alkbh8 | | ■ | | | | | |
| NM_139121 | NM_139121 | | ■ | | | | | |
| NM_139244 | STXBP5 | | ■ | | | | | |
| NM_144602 | C16orf78 | | ■ | | | | | |
| NM_144969 | ZDHHC15 | | ■ | | | | | |
| NM_145266 | NUDCD2 | | ■ | | | | | |
| NM_147197 | WFDC11 | | ■ | | | | | |
| NM_148176 | ppil2 | | ■ | | | | | |
| NM_152353 | CLDND2 | | ■ | | | | | |
| NM_152421 | Fam69b | | ■ | | | | | |
| NM_153686 | LCORL | | ■ | | | | | |
| NM_172014 | Tnfsf14 | | ■ | | | | | |
| NM_172070 | UBR3 | | ■ | | | | | |
| NM_175923 | NM_175923 | | ■ | | | | | |
| NM_198498 | C11orf53 | | ■ | | | | | |
| NM_205859 | OR2K2 | | ■ | | | | | |
| NM_206836 | PECI | | ■ | | | | | |
| NM_207647 | FSD1L | | ■ | | | | | |
| XM_379117 | XM_379117 | | ■ | | | | | |
| BC008288 | ubxn6 | | ■ | | | | | ■ |
| NM_003907 | Eif2b5 | | ■ | | | | | ■ |
| NM_032641 | Spsb2 | | ■ | | | | | ■ |
| NM_182644 | EPHA3 | | ■ | | | | | ■ |
| NM_198266 | NM_198266 | | ■ | | | | | ■ |
| BC041133 | RASL10B | | ■ | | | | ■ | |
| NM_004073 | plk3 | | ■ | | | | ■ | |
| NM_004179 | TPH1 | | ■ | | | | ■ | |
| NM_004311 | Arl3 | | ■ | | | | ■ | |
| NM_006570 | rraga | | ■ | | | | ■ | |
| NM_013313 | YPEL1 | | ■ | | | | ■ | |
| NM_022823 | Fndc4 | | ■ | | | | ■ | |
| NM_080588 | PTPN7 | | ■ | | | | ■ | |
| NM_144593 | Rhebl1 | | ■ | | | | ■ | |
| NM_173470 | MMGT1 | | ■ | | | | ■ | |
| XM_374026 | XM_374026 | | ■ | | | | ■ | |
| NM_000166 | GJB1 | | ■ | | | | ■ | ■ |
| NM_001014796 | DDR2 | | ■ | | | | ■ | ■ |
| NM_016000 | NM_016000 | | ■ | | | | ■ | ■ |
| NM_016495 | TBC1D7 | | ■ | | | | ■ | ■ |
| NM_194358 | Rnf41 | | ■ | | | | ■ | ■ |
| XM_378240 | XM_378240 | | ■ | | | | ■ | |
| BC001728 | TFPT | | ■ | | | ■ | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| BC002940 | ZXDC | | X | | | X | | |
| BC003566 | ZNF24 | | X | | | X | | |
| BC007363 | BCKDK | | X | | | X | | |
| BC011562 | Sp100 | | X | | | X | | |
| BC011668 | Csnk2a1 | | X | | | X | | |
| BC022253 | Slc6a15 | | X | | | X | | |
| BC026961 | MITF | | X | | | X | | |
| BC030833 | NDUFS1 | | X | | | X | | |
| BC033491 | ADAD2 | | X | | | X | | |
| BC036450 | SAMHD1 | | X | | | X | | |
| BC036572 | ZCCHC12 | | X | | | X | | |
| BC040949 | MEF2D | | X | | | X | | |
| BC043247 | TLE3 | | X | | | X | | |
| BC050425 | ZNF322A | | X | | | X | | |
| BC056402 | C11orf84 | | X | | | X | | |
| BC059386 | Skil | | X | | | X | | |
| BC060847 | Pard6b | | X | | | X | | |
| BC063451 | tcp10 | | X | | | X | | |
| BC064700 | esrrg | | X | | | X | | |
| BC067299 | MDM4 | | X | | | X | | |
| BC068555 | arhgap26 | | X | | | X | | |
| NM_001008239 | c18orf25 | | X | | | X | | |
| NM_001626 | akt2 | | X | | | X | | |
| NM_001722 | Polr3d | | X | | | X | | |
| NM_001910 | CTSE | | X | | | X | | |
| NM_002011 | Fgfr4 | | X | | | X | | |
| NM_003211 | TDG | | X | | | X | | |
| NM_003345 | UBE2I | | X | | | X | | |
| NM_003821 | RIPK2 | | X | | | X | | |
| NM_004454 | ETV5 | | X | | | X | | |
| NM_006819 | stip1 | | X | | | X | | |
| NM_006977 | ZBTB25 | | X | | | X | | |
| NM_007277 | EXOC3 | | X | | | X | | |
| NM_013301 | CCDC106 | | X | | | X | | |
| NM_013328 | PYCR2 | | X | | | X | | |
| NM_013342 | TFPT | | X | | | X | | |
| NM_014570 | arfgap3 | | X | | | X | | |
| NM_014763 | MRPL19 | | X | | | X | | |
| NM_015363 | PEG3AS | | X | | | X | | |
| NM_016231 | nlk | | X | | | X | | |
| NM_017542 | Pogk | | X | | | X | | |
| NM_019884 | GSK3A | | X | | | X | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_021138 | traF2 | | X | | | X | | |
| NM_022493 | NARFL | | X | | | X | | |
| NM_023926 | ZSCAN18 | | X | | | X | | |
| NM_031414 | STK31 | | X | | | X | | |
| NM_032752 | ZNF496 | | X | | | X | | |
| NM_033003 | NM_033003 | | X | | | X | | |
| NM_080612 | GAB3 | | X | | | X | | |
| NM_145796 | POGZ | | X | | | X | | |
| NM_177559 | Csnk2a1 | | X | | | X | | |
| NM_178425 | hdac9 | | X | | | X | | |
| NM_178483 | C20orf79 | | X | | | X | | |
| NM_212540 | NM_212540 | | X | | | X | | |
| BC017314 | ETS1 | | X | | | | | X |
| NM_001240 | CCNT1 | | X | | | | | X |
| NM_003242 | Tgfbr2 | | X | | | | | X |
| NM_004586 | Rps6ka3 | | X | | | | | X |
| NM_007242 | DDX19B | | X | | | | | X |
| NM_012472 | LRRC6 | | X | | | | | X |
| NM_015149 | RGL1 | | X | | | | | X |
| NM_018492 | PBK | | X | | | | | X |
| NM_139181 | NM_139181 | | X | | | | | X |
| NM_152434 | CWF19L2 | | X | | | X | | X |
| BC009010 | C6orf142 | | X | | | X | X | |
| NM_000154 | Galk1 | | X | | | X | X | X |
| NM_003137 | srpk1 | | X | | | X | X | X |
| NM_005592 | MUSK | | X | | | X | | X |
| NM_014583 | LMCD1 | | X | | | X | | X |
| BC000306 | hadh | | X | | X | | | |
| BC011776 | tpm2 | | X | | X | | | |
| BC014640 | col14a1 | | X | | X | | | |
| BC015818 | LGALS8 | | X | | X | | | |
| BC016634 | QARS | | X | | X | | | |
| BC022244 | Pycr1 | | X | | X | | | |
| BC022888 | xirp2 | | X | | X | | | |
| BC027911 | JMJD5 | | X | | X | | | |
| BC054520 | MEF2D | | X | | X | | | |
| NM_001004299 | NM_001004299 | | X | | X | | | |
| NM_003592 | CUL1 | | X | | X | | | |
| NM_005566 | LdhA | | X | | X | | | |
| NM_006521 | TFE3 | | X | | X | | | |
| NM_006802 | sf3a3 | | X | | X | | | |
| NM_014077 | Fam32a | | X | | X | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_020944 | GBA2 | | ▓ | | ▓ | | | |
| NM_021972 | SPHK1 | | ▓ | | ▓ | | | |
| NM_138443 | Haus1 | | ▓ | | ▓ | | | |
| NM_138468 | Ica1l | | ▓ | | ▓ | | | |
| BC026213 | Fbxw11 | | ▓ | | ▓ | ▓ | | |
| NM_016123 | IRAK4 | | ▓ | | ▓ | ▓ | | |
| NM_198204 | MLX | | ▓ | | ▓ | ▓ | | |
| NM_002489 | Ndufa4 | | ▓ | | ▓ | ▓ | ▓ | |
| NM_001032296 | stk24 | | ▓ | | ▓ | ▓ | ▓ | ▓ |
| NM_033118 | MYLK2 | | ▓ | | ▓ | ▓ | ▓ | ▓ |
| BC000238 | Ankzf1 | | ▓ | ▓ | | | | |
| BC000784 | BIRC5 | | ▓ | ▓ | | | | |
| BC003193 | LRRC1 | | ▓ | ▓ | | | | |
| BC004219 | AGPAT3 | | ▓ | ▓ | | | | |
| BC005008 | Ceacam6 | | ▓ | ▓ | | | | |
| BC009894 | PAPSS2 | | ▓ | ▓ | | | | |
| BC011460 | CHI3L2 | | ▓ | ▓ | | | | |
| BC011707 | nrbf2 | | ▓ | ▓ | | | | |
| BC012001 | CEACAM21 | | ▓ | ▓ | | | | |
| BC012984 | PARD3B | | ▓ | ▓ | | | | |
| BC014051 | AIMP1 | | ▓ | ▓ | | | | |
| BC015109 | MRPL1 | | ▓ | ▓ | | | | |
| BC017789 | LOC727896 | | ▓ | ▓ | | | | |
| BC029562 | C8orf56 | | ▓ | ▓ | | | | |
| BC033818 | vstm2l | | ▓ | ▓ | | | | |
| BC036365 | C10orf81 | | ▓ | ▓ | | | | |
| BC037854 | Dync1i1 | | ▓ | ▓ | | | | |
| BC040106 | NOP16 | | ▓ | ▓ | | | | |
| BC040272 | IL16 | | ▓ | ▓ | | | | |
| BC044574 | Echdc2 | | ▓ | ▓ | | | | |
| BC057808 | HAPLN1 | | ▓ | ▓ | | | | |
| BC059364 | PTGR2 | | ▓ | ▓ | | | | |
| BC062353 | c1orf131 | | ▓ | ▓ | | | | |
| BC069568 | TRIM46 | | ▓ | ▓ | | | | |
| NM_001007258 | NM_001007258 | | ▓ | ▓ | | | | |
| NM_001168 | BIRC5 | | ▓ | ▓ | | | | |
| NM_001197 | BIK | | ▓ | ▓ | | | | |
| NM_001219 | CALU | | ▓ | ▓ | | | | |
| NM_001384 | DPH2 | | ▓ | ▓ | | | | |
| NM_001932 | MPP3 | | ▓ | ▓ | | | | |
| NM_003953 | MPZL1 | | ▓ | ▓ | | | | |
| NM_004755 | RPS6KA5 | | ▓ | ▓ | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_005446 | P2RX6 |  | ▓ | ▓ |  |  |  |  |
| NM_006433 | GNLY |  | ▓ | ▓ |  |  |  |  |
| NM_012247 | sephs1 |  | ▓ | ▓ |  |  |  |  |
| NM_014868 | RNF10 |  | ▓ | ▓ |  |  |  |  |
| NM_015417 | Spef1 |  | ▓ | ▓ |  |  |  |  |
| NM_015929 | LIPT1 |  | ▓ | ▓ |  |  |  |  |
| NM_016836 | RBMS1 |  | ▓ | ▓ |  |  |  |  |
| NM_017437 | cpsf2 |  | ▓ | ▓ |  |  |  |  |
| NM_017588 | WDR5 |  | ▓ | ▓ |  |  |  |  |
| NM_021178 | CCNB1IP1 |  | ▓ | ▓ |  |  |  |  |
| NM_022140 | EPB41L4A |  | ▓ | ▓ |  |  |  |  |
| NM_022754 | SFXN1 |  | ▓ | ▓ |  |  |  |  |
| NM_025083 | EDC3 |  | ▓ | ▓ |  |  |  |  |
| NM_032028 | TSSK1B |  | ▓ | ▓ |  |  |  |  |
| NM_032407 | PCDHGA12 |  | ▓ | ▓ |  |  |  |  |
| NM_032943 | SYTL2 |  | ▓ | ▓ |  |  |  |  |
| NM_053285 | tekt1 |  | ▓ | ▓ |  |  |  |  |
| NM_080414 | VPS16 |  | ▓ | ▓ |  |  |  |  |
| NM_144591 | C10orf32 |  | ▓ | ▓ |  |  |  |  |
| NM_145911 | ZNF23 |  | ▓ | ▓ |  |  |  |  |
| NM_152420 | C9orf41 |  | ▓ | ▓ |  |  |  |  |
| NM_213645 | wars |  | ▓ | ▓ |  |  |  |  |
| BC002448 | ABLIM1 |  | ▓ | ▓ |  |  |  | ▓ |
| BC008567 | C21orf7 |  | ▓ | ▓ |  |  |  | ▓ |
| NM_004732 | Kcnab3 |  | ▓ | ▓ |  |  |  | ▓ |
| NM_016058 | TPRKB |  | ▓ | ▓ |  |  |  | ▓ |
| NM_199124 | C11orf63 |  | ▓ | ▓ |  |  |  | ▓ |
| BC025254 | INTS3 |  | ▓ | ▓ |  |  | ▓ |  |
| BC027978 | IL6 |  | ▓ | ▓ |  |  | ▓ |  |
| NM_032329 | ing5 |  | ▓ | ▓ |  |  | ▓ |  |
| NM_174940 | Tmem80 |  | ▓ | ▓ |  |  | ▓ |  |
| BC020985 | COASY |  | ▓ | ▓ |  |  | ▓ | ▓ |
| BC007048 | ZMYM5 |  | ▓ | ▓ |  | ▓ |  |  |
| BC011804 | BEND5 |  | ▓ | ▓ |  | ▓ |  |  |
| BC013115 | RBM9 |  | ▓ | ▓ |  | ▓ |  |  |
| BC014969 | Atf6 |  | ▓ | ▓ |  | ▓ |  |  |
| BC015803 | irf2 |  | ▓ | ▓ |  | ▓ |  |  |
| BC016470 | EME1 |  | ▓ | ▓ |  | ▓ |  |  |
| BC030711 | aplf |  | ▓ | ▓ |  | ▓ |  |  |
| BC051688 | PNMAL1 |  | ▓ | ▓ |  | ▓ |  |  |
| NM_000142 | fgfr3 |  | ▓ | ▓ |  | ▓ |  |  |
| NM_001006665 | RPS6KA1 |  | ▓ | ▓ |  | ▓ |  |  |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_001278 | CHUK | | X | X | | X | | |
| NM_001292 | NM_001292 | | X | X | | X | | |
| NM_001728 | bsg | | X | X | | X | | |
| NM_002752 | Mapk9 | | X | X | | X | | |
| NM_004215 | ebag9 | | X | X | | X | | |
| NM_004217 | AURKB | | X | X | | X | | |
| NM_005160 | Adrbk2 | | X | X | | X | | |
| NM_005550 | Kifc3 | | X | X | | X | | |
| NM_005639 | Syt1 | | X | X | | X | | |
| NM_005734 | Hipk3 | | X | X | | X | | |
| NM_012224 | nek1 | | X | X | | X | | |
| NM_013254 | Tbk1 | | X | X | | X | | |
| NM_014280 | DNAJC8 | | X | X | | X | | |
| NM_016096 | ZNF706 | | X | X | | X | | |
| NM_019023 | prmt7 | | X | X | | X | | |
| NM_020168 | Pak6 | | X | X | | X | | |
| NM_032345 | wibg | | X | X | | X | | |
| NM_032360 | acbd6 | | X | X | | X | | |
| NM_145914 | ZSCAN21 | | X | | | X | | |
| NM_178010 | SOX5 | | X | | | X | | |
| BC010125 | C3orf37 | | X | X | | X | | X |
| BC041132 | Kifc3 | | X | X | | X | | X |
| BC051695 | FRMD8 | | X | X | | X | | X |
| NM_000141 | FGFR2 | | X | X | | X | | X |
| NM_001039468 | MARK2 | | X | X | | X | | X |
| NM_001220 | Camk2b | | X | | | X | | X |
| NM_001571 | IRF3 | | X | | | X | | X |
| NM_001699 | AXL | | X | | | X | | X |
| NM_002740 | PRKCI | | X | X | | X | | X |
| NM_002744 | Prkcz | | X | | | X | | X |
| NM_003668 | MAPKAPK5 | | X | | | X | | X |
| NM_004635 | mapkapk3 | | X | X | | | | X |
| NM_005038 | ppiD | | X | | | | | X |
| NM_005400 | Prkce | | X | | | | | X |
| NM_006254 | PRKCD | | X | | | | | X |
| NM_006281 | Stk3 | | X | | | | | X |
| NM_012325 | Mapre1 | | X | | | | | X |
| NM_014840 | NUAK1 | | X | | | | | X |
| NM_025241 | ubxn6 | | X | | | | | X |
| NM_030662 | LOC407835 | | X | | | | | X |
| NM_032141 | CCDC55 | | X | | | | | X |
| NM_144659 | TCP10L | | X | | | | | X |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_172160 | KCNAB1 | | ▒ | ▒ | | ▒ | | ▒ |
| BC033817 | PSIP1 | | ▒ | ▒ | | ▒ | ▒ | |
| NM_001348 | dapk3 | | ▒ | ▒ | | ▒ | ▒ | |
| NM_020666 | clk4 | | ▒ | ▒ | | ▒ | | ▒ |
| BC021189 | BC021189 | | ▒ | ▒ | | ▒ | | ▒ |
| BC024725 | ANKRD50 | | ▒ | ▒ | | ▒ | | |
| BC058924 | UBE2MP1 | | ▒ | ▒ | | ▒ | | |
| NM_175907 | ZADH2 | | ▒ | ▒ | ▒ | | | |
| BC002755 | mknk1 | | ▒ | ▒ | ▒ | | | |
| BC009650 | PDS5A | | ▒ | ▒ | ▒ | | | |
| NM_004724 | ZW10 | | ▒ | ▒ | | | | |
| NM_014815 | MED24 | | ▒ | ▒ | | | | |
| NM_015014 | Rbm34 | | ▒ | ▒ | | | | |
| NM_133332 | NM_133332 | | ▒ | ▒ | | | | |
| NM_177974 | CASC4 | | ▒ | ▒ | | | | |
| NM_144594 | GTSF1 | | ▒ | ▒ | | | | ▒ |
| NM_198517 | Tbc1d10c | | ▒ | ▒ | | | | ▒ |
| BC008730 | HK1 | | ▒ | ▒ | | | ▒ | |
| BC015596 | FAM165B | | ▒ | ▒ | | | | |
| BC022436 | TPT1 | | ▒ | ▒ | | | | |
| NM_014245 | rnf7 | | ▒ | ▒ | | | ▒ | ▒ |
| BC008141 | haus7 | | ▒ | ▒ | ▒ | | | |
| BC009993 | C3orf37 | | ▒ | ▒ | ▒ | | | |
| BC041831 | TLE3 | | ▒ | ▒ | ▒ | | | |
| NM_001006932 | RPS6KA2 | | ▒ | ▒ | ▒ | | | |
| NM_005158 | abl2 | | ▒ | ▒ | ▒ | | | |
| NM_005233 | EPHA3 | | ▒ | ▒ | ▒ | | | |
| NM_014240 | LIMD1 | | ▒ | ▒ | ▒ | | | |
| NM_014720 | SLK | | ▒ | ▒ | ▒ | | | |
| NM_015981 | Camk2a | | ▒ | ▒ | ▒ | | | |
| NM_018679 | Tcp11 | | | ▒ | ▒ | | | |
| NM_024099 | c11orf48 | | | ▒ | ▒ | | | |
| NM_031845 | map2 | | | ▒ | ▒ | | | |
| NM_053006 | Tssk2 | | | ▒ | ▒ | | | |
| NM_145865 | ANKS4B | | | ▒ | ▒ | | | |
| BC038838 | Prr16 | | | ▒ | ▒ | | | ▒ |
| BC056415 | rpap3 | | | ▒ | ▒ | | | ▒ |
| NM_001221 | CAMK2D | | | ▒ | ▒ | | | ▒ |
| NM_002005 | fes | | | ▒ | ▒ | | | ▒ |
| BC001772 | QARS | | | ▒ | ▒ | | ▒ | ▒ |
| NM_002477 | MYL5 | | | ▒ | ▒ | | | |
| NM_014215 | INSRR | | | ▒ | ▒ | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_181555 | NM_181555 | | ▨ | ▨ | ▨ | ▨ | ▨ | |
| NM_130807 | MOBKL2A | | ▨ | ▨ | ▨ | ▨ | ▨ | ▨ |
| BC005139 | USP5 | ▨ | | | | | | |
| BC010369 | Rnf111 | ▨ | | | | | | |
| BC013173 | rspry1 | ▨ | | | | | | |
| BC015569 | ARL6IP4 | ▨ | | | | | | |
| BC018995 | FAM70B | ▨ | | | | | | |
| BC021988 | NDFIP2 | ▨ | | | | | | |
| BC023982 | C5orf32 | ▨ | | | | | | |
| BC026032 | Prrg2 | ▨ | | | | | | |
| BC026126 | NDFIP2 | ▨ | | | | | | |
| BC029775 | TMEM61 | ▨ | | | | | | |
| BC032833 | ANKRD13A | ▨ | | | | | | |
| BC054049 | RNF115 | ▨ | | | | | | |
| NM_000462 | Ube3a | ▨ | | | | | | |
| NM_002810 | PSMD4 | ▨ | | | | | | |
| NM_002946 | RPA2 | ▨ | | | | | | |
| NM_003831 | Riok3 | ▨ | | | | | | |
| NM_004064 | CDKN1B | ▨ | | | | | | |
| NM_004252 | SLC9A3R1 | ▨ | | | | | | |
| NM_005053 | RAD23A | ▨ | | | | | | |
| NM_006145 | DNAJB1 | ▨ | | | | | | |
| NM_007106 | ubl3 | ▨ | | | | | | |
| NM_012478 | WBP2 | ▨ | | | | | | |
| NM_013444 | UBQLN2 | ▨ | | | | | | |
| NM_014613 | FAF2 | ▨ | | | | | | |
| NM_016483 | Phf7 | ▨ | | | | | | |
| NM_016638 | ARL6IP4 | ▨ | | | | | | |
| NM_017787 | C10orf26 | ▨ | | | | | | |
| NM_018710 | Tmem55a | ▨ | | | | | | |
| NM_019099 | c1orf183 | ▨ | | | | | | |
| NM_020182 | PMEPA1 | ▨ | | | | | | |
| NM_020199 | C5orf15 | ▨ | | | | | | |
| NM_020631 | PLEKHG5 | ▨ | | | | | | |
| NM_020801 | arrdc3 | ▨ | | | | | | |
| NM_021204 | ENOPH1 | ▨ | | | | | | |
| NM_024081 | PRRG4 | ▨ | | | | | | |
| NM_024585 | ARMC7 | ▨ | | | | | | |
| NM_024948 | fam188a | ▨ | | | | | | |
| NM_030571 | NDFIP1 | ▨ | | | | | | |
| NM_032182 | Fam175b | ▨ | | | | | | |
| NM_032326 | TMEM175 | ▨ | | | | | | |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_080659 | C11orf52 | ✓ | | | | | | |
| NM_130465 | Tspan17 | ✓ | | | | | | |
| NM_152267 | RNF185 | ✓ | | | | | | |
| NM_152285 | Arrdc1 | ✓ | | | | | | |
| NM_153217 | Tmem174 | ✓ | | | | | | |
| NM_153229 | TMEM92 | ✓ | | | | | | |
| NM_153237 | C9orf71 | ✓ | | | | | | |
| NM_153345 | TMEM139 | ✓ | | | | | | |
| NM_174902 | LDLRAD3 | ✓ | | | | | | |
| NM_194271 | RNF34 | ✓ | | | | | | |
| NM_194460 | RNF126 | ✓ | | | | | | |
| XM_375359 | XM_375359 | ✓ | | | | | | |
| BC046151 | TOM1 | ✓ | | | | | | ✓ |
| NM_153822 | NM_153822 | ✓ | | | | | | |
| BC009631 | dci | ✓ | | | | | ✓ | |
| NM_006213 | phkg1 | ✓ | | | | | ✓ | |
| NM_006293 | tyro3 | ✓ | | | | | ✓ | ✓ |
| BC013112 | SLC23A2 | ✓ | | | | ✓ | | ✓ |
| BC033711 | ATXN3 | ✓ | | | | | ✓ | ✓ |
| NM_002944 | ROS1 | ✓ | | | | | ✓ | |
| NM_004783 | taok2 | ✓ | | | | ✓ | ✓ | |
| NM_005246 | fer | ✓ | | | | ✓ | ✓ | |
| BC017572 | PVRL3 | ✓ | | | | | ✓ | ✓ |
| NM_002020 | Flt4 | ✓ | | | | | ✓ | |
| NM_005546 | ITK | ✓ | | | | | ✓ | |
| NM_024591 | CHMP6 | ✓ | | | ✓ | | | |
| BC004967 | ubac1 | ✓ | | | ✓ | | | ✓ |
| NM_001033551 | TOM1L2 | | | | ✓ | | | |
| BC054508 | epb4l5 | ✓ | | ✓ | | | | |
| NM_018297 | ngly1 | ✓ | | ✓ | | | | |
| BC044239 | ANKRD13D | ✓ | | ✓ | | | ✓ | ✓ |
| BC060833 | Prrg1 | ✓ | | | ✓ | | ✓ | ✓ |
| BC020221 | Stac | ✓ | | ✓ | | | | ✓ |
| BC025700 | AFF4 | ✓ | | ✓ | | | | ✓ |
| BC053895 | IRS1 | ✓ | | ✓ | | | | ✓ |
| NM_002135 | NR4A1 | ✓ | ✓ | | | | | |
| BC060862 | Rnf111 | ✓ | ✓ | | | ✓ | | |
| NM_001619 | ADRBK1 | ✓ | ✓ | | | ✓ | | |
| NM_002938 | LOC644006 | ✓ | ✓ | | | ✓ | | |
| NM_001556 | IKBKB | ✓ | ✓ | | | ✓ | ✓ | |
| NM_004972 | Jak2 | ✓ | ✓ | | | ✓ | | |
| NM_080823 | SRMS | ✓ | ✓ | | | ✓ | ✓ | ✓ |

Figure 3 (Continued)

| GeneBank | Gene Symbol | Ubiquitin | SUMO2/3 | NEDD8 | FAT10 | SUMO1 | UFM1 | ISG15 |
|---|---|---|---|---|---|---|---|---|
| NM_000875 | IGF1R | ✓ | ✓ |  | ✓ | ✓ | ✓ |  |
| BC015219 | RBCK1 | ✓ | ✓ |  | ✓ | ✓ | ✓ | ✓ |
| BC000877 | AVPI1 | ✓ | ✓ | ✓ |  |  |  |  |
| BC014475 | BIRC7 | ✓ | ✓ | ✓ |  |  |  |  |
| BC029046 | H1f0 | ✓ | ✓ | ✓ |  |  |  |  |
| NM_001025105 | csnk1a1 | ✓ | ✓ | ✓ |  |  |  |  |
| NM_194463 | RNF128 | ✓ | ✓ |  |  |  |  |  |
| BC016381 | IGHV3-11 | ✓ | ✓ |  |  |  |  | ✓ |
| NM_002648 | Pim1 | ✓ | ✓ |  |  | ✓ |  | ✓ |
| NM_002739 | PRKCG | ✓ | ✓ |  |  | ✓ |  | ✓ |
| NM_003600 | AURKA | ✓ | ✓ |  |  | ✓ |  | ✓ |
| NM_005030 | PLK1 | ✓ | ✓ |  |  | ✓ |  | ✓ |
| NM_005211 | csf1r | ✓ | ✓ |  |  | ✓ |  | ✓ |
| NM_014397 | Nek6 | ✓ | ✓ |  |  | ✓ |  | ✓ |
| NM_020397 | Camk1d | ✓ | ✓ |  |  | ✓ |  | ✓ |
| NM_023109 | NM_023109 | ✓ | ✓ |  |  | ✓ |  | ✓ |
| NM_152634 | tceanc | ✓ | ✓ |  |  | ✓ |  | ✓ |
| NM_002019 | FLT1 | ✓ | ✓ |  |  | ✓ | ✓ |  |
| NM_015148 | PASK | ✓ | ✓ |  |  | ✓ | ✓ |  |
| NM_138551 | TSLP | ✓ | ✓ |  |  | ✓ | ✓ |  |
| NM_170672 | rasgrp3 | ✓ | ✓ |  |  | ✓ | ✓ |  |
| NM_003141 | TRIM21 | ✓ | ✓ |  |  | ✓ |  | ✓ |
| NM_003157 | NEK4 | ✓ | ✓ |  |  | ✓ |  | ✓ |
| NM_006259 | PRKG2 | ✓ | ✓ |  |  | ✓ |  | ✓ |
| NM_021709 | SIVA1 | ✓ | ✓ |  |  | ✓ |  | ✓ |
| NM_023940 | RASL11B | ✓ | ✓ |  |  | ✓ |  | ✓ |
| NM_173822 | FAM126B | ✓ | ✓ |  |  | ✓ |  | ✓ |
| BC018137 | TAF1B | ✓ | ✓ |  | ✓ |  |  | ✓ |
| NM_004329 | LOC643778 | ✓ | ✓ |  | ✓ |  |  | ✓ |
| NM_145173 | DIRAS1 | ✓ | ✓ |  | ✓ |  |  | ✓ |
| NM_006257 | prkcq | ✓ | ✓ |  | ✓ |  | ✓ | ✓ |
| NM_017949 | CUEDC1 | ✓ | ✓ |  | ✓ |  | ✓ | ✓ |
| NM_212535 | PRKCB | ✓ | ✓ |  | ✓ | ✓ |  | ✓ |
| NM_000585 | IL15 | ✓ | ✓ |  | ✓ | ✓ | ✓ |  |
| NM_152619 | NM_152619 | ✓ | ✓ |  | ✓ | ✓ | ✓ | ✓ |

FIG. 6

Molecular Functions

| | UFM1 | UBIQUITIN | NEDD8 | SUMO2/3 | SUMO1 | ISG15 | FAT10 | |
|---|---|---|---|---|---|---|---|---|
| | | | | | | ▨ | | adenylate cyclase activity |
| | | | | | | ▨ | | translation initiation factor activity |
| | | | | | | ▨ | | enzyme regulator activity |
| | | | | | | ▨ | | RNA binding |
| | ▨ | | | | | | | peroxidase activity |
| | ▨ | | | | | | | oxidoreductase activity |
| | ▨ | | | | | | | hydrolase activity |
| | ▨ | | | | | | | GTPase activity |
| | ▨ | | | | | | | gap junction channel activity |
| | ▨ | | | | | | | cation channel activity |
| | ▨ | | | | | | | cytokine receptor activity |
| | ▨ | | | | | | | cation transmembrane transporter activity |
| | ▨ | | | | | | | voltage-gated potassium channel activity |
| | ▨ | | | | | | | antioxidant activity |
| | | ▨ | | | | | | ubiquitin-protein ligase activity |
| | | | | | | ▨ | | phosphatase regulator activity |
| | | | | | | ▨ | | phosphatase inhibitor activity |
| | | | | | | ▨ | | SNAP receptor activity |
| | | | | | | ▨ | | extracellular matrix structural constituent |
| | | | | | | ▨ | | DNA helicase activity |
| | | | | ▨ | | | | guanyl-nucleotide exchange factor activity |
| | | | | ▨ | | | | small GTPase regulator activity |
| | | | | ▨ | ▨ | | | DNA binding |
| | | | | | ▨ | | | transcription co/factor activity |
| | | | | | ▨ | | | nucleic acid binding |
| | | | | | ▨ | ▧ | | DNA topoisomerase activity |
| | ▨ | | ▨ | | | ▧ | | protein binding |
| | ▨ | ▨ | ▨ | | | ▧ | | receptor binding |
| | ▨ | ▨ | ▨ | | | ▧ | | transmembrane receptor kinase |
| | ▨ | ▨ | ▨ | | | ▧ | | receptor activity |
| | ▨ | ▨ | ▨ | | | ▧ | | kinase activity |
| | | ▨ | ▨ | ▨ | | ▧ | | calmodulin binding |
| | | ▨ | ▨ | ▨ | ▨ | ▧ | | calcium-dependent phospholipid binding |
| | | ▨ | ▨ | ▨ | ▨ | ▧ | | calcium ion binding |
| | | ▨ | ▨ | ▨ | ▨ | ▧ | | cytoskeletal protein binding |

Figure 9
A
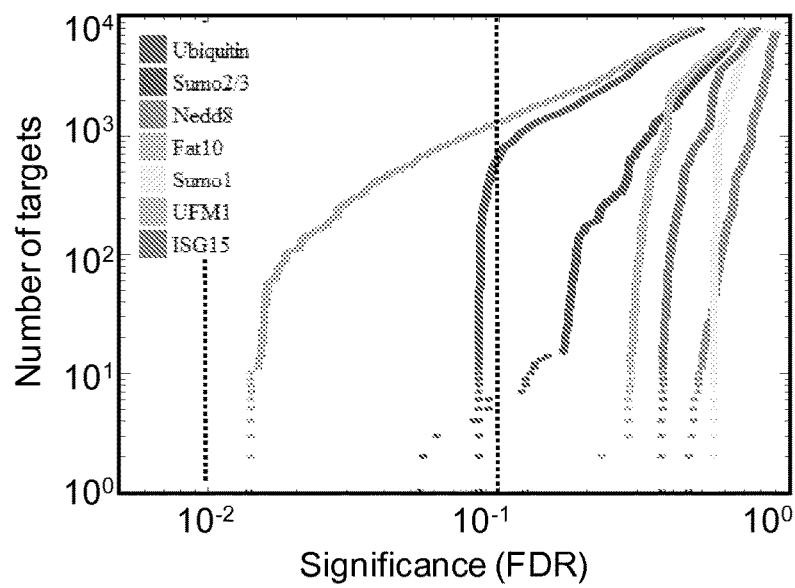
B
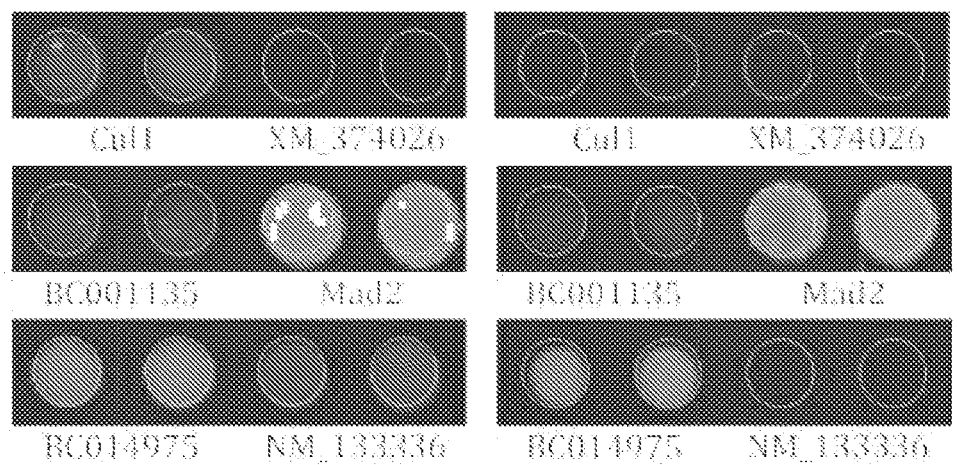

Figure 10
A  Arrested Vs Arrested (protein vs. peptide
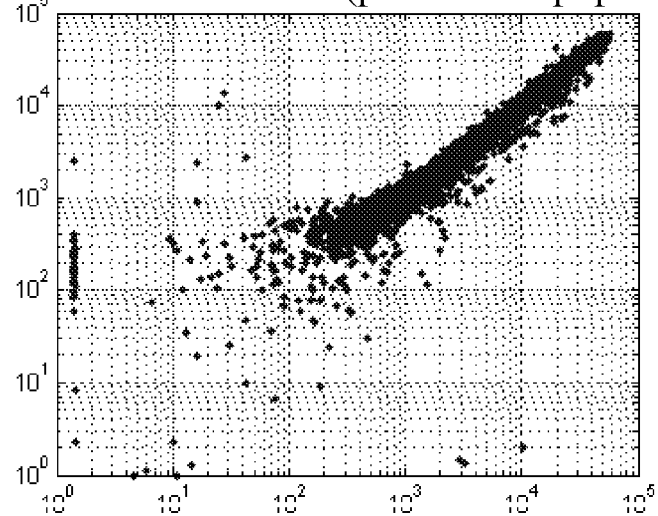
B  Arrested Vs Arrested (3x SDS0.5% wash)
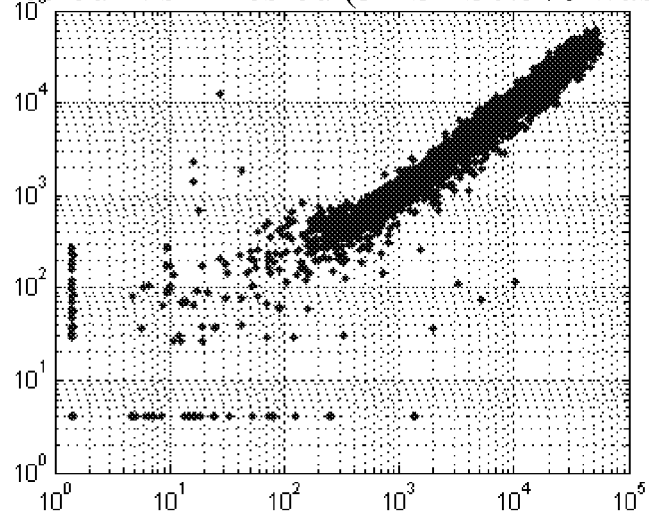

Figure 16
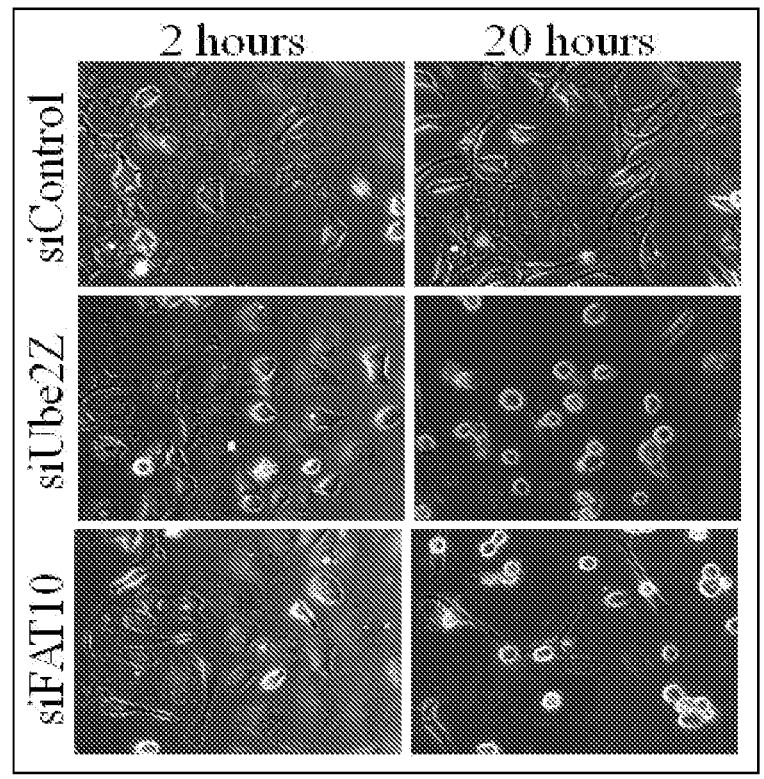
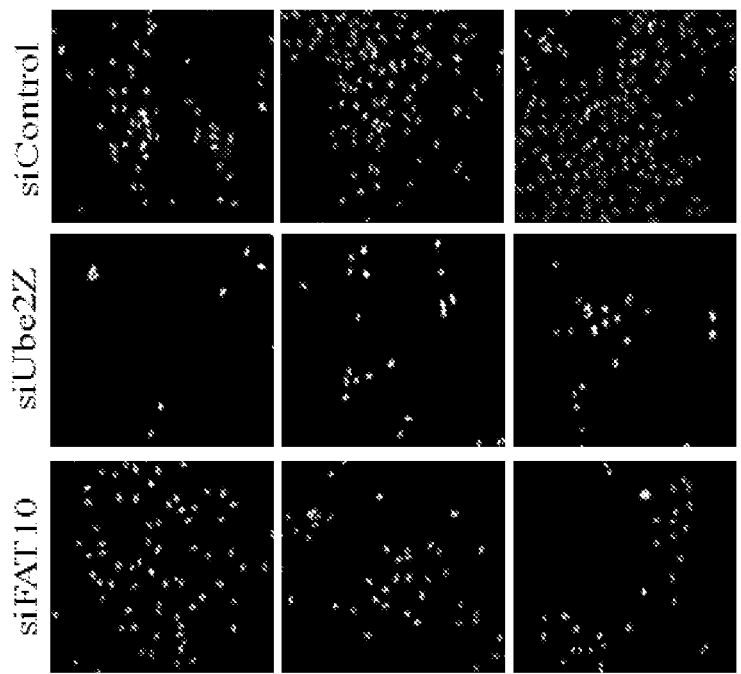

FAT10 Nucleic Acid Sequence (SEQ ID NO: 1)

```
1    gattgcttga ggagagaagt atgtgatcag aaagcattct ttgtctatta actcctgccc
61   agcaaaagtg aaagaaaatt catgggagca tgcaagaaca aagagcacag caaagctgga
121  caaacacagc aatccaggca ggggatttcc aactcaactc tggtatataa gctgcatgca
181  aagtcctttt tctgtctctg gtttctggcc ccttgtctgc agagatggct cccaatgctt
241  cctgcctctg tgtgcatgtc cgttccgagg aatgggattt aatgaccttt gatgccaacc
301  catatgacag cgtgaaaaaa atcaaagaac atgtccggtc taagaccaag gttcctgtgc
361  aggaccaggt tcttttgctg ggctccaaga tcttaaagcc acggagaagc ctctcatctt
421  atggcattga caaagagaag accatccacc ttaccctgaa agtggtgaag cccagtgatg
481  aggagctgcc cttgtttctt gtggagtcag gtgatgaggc aaagaggcac ctcctccagg
541  tgcgaaggtc cagctcagtg cacaagtga agcaatgat cgagactaag acgggtataa
601  tccctgagac ccagattgtg acttgcaatg gaaagagact ggaagatggg aagatgatgg
661  cagattacgg catcagaaag ggcaacttac tcttcctggc atgttattgt attggagggt
721  gaccaccctg ggcatggggt gttggcaggg gtcaaaaagc ttatttcttt taatctctta
781  ctcaacgaac acatcttctg atgatttccc aaaattaatg agaatgagat gagtagagta
841  agatttgggt gggatgggta ggatgaagta tattgcccaa ctctatgttt ctttgattct
901  aacacaatta attaagtgac atgatttta ctaatgtatt actgagacta gtaaataaat
961  tttaaggca aatagagca ttcaaagcca aaaaaaaaa aaaaaa
```

B

FAT10 Amino Acid Sequence (SEQ ID NO: 2)

```
1    mapnasclcv hvrseewdlm tfdanpydsv kkikehvrsk tkvpvqdqvl llgskilkpr
61   rslssygidk ektihltlkv vkpsdeelpl flvesgdeak rhllqvrrss svaqvkamie
121  tktgiipetq ivtcngkrle dgkmmadygi rkgnllflac ycigg
```

Figure 20

FAT10 Substrate Nucleic Acid Sequences (SEQ ID NO: 3-465, respectively)

>gi|33875085|gb|BC000001.2| Homo sapiens chitinase domain containing 1, mRNA
(cDNA clone MGC:3234 IMAGE:3504261), complete cds
CCGGCCTCCCTGACATGCAGATTTCCACCCAGAAGACAGAGAAGGAGCCAGTGGTCATGGAATGGGCTGG
GGTCAAAGACTGGGTGCCTGGGAGCTGAGGCAGCCACCGTTTCAGCCTGGCCAGCCCTCTGGACCCCGAG
GTTGGACCCTACTGTGACACACCTACCATGCGGACACTCTTCAACCTCCTCTGGCTTGCCCTGGCCTGCA
GCCCTGTTCACACTACCCTGTCAAAGTCAGATGCCAAAAAAGCCGCCTCAAAGACGCTGCTGGAGAAGAG
TCAGTTTTCAGATAAGCCGGTGCAAGACCGGGGTTTGGTGGTGACGGACCTCAAAGCTGAGAGTGTGGTT
CTTGAGCATCGCAGCTACTGCTCGGCAAAGGCCCGGGACAGACACTTTGCTGGGGATGTACTGGGCTATG
TCACTCCATGGAACAGCCATGGCTACGATGTCACCAAGGTCTTTGGGAGCAAGTTCACACAGATCTCACC
CGTCTGGCTGCAGCTGAAGAGACGTGGCCGTGAGATGTTTGAGGTCACGGGCCTCCACGACGTGGACCAA
GGGTGGATGCGAGCTGTCAGGAAGCATGCCAAGGGCCTGCACATAGTGCCTCGGCTCCTGTTTGAGGACT
GGACTTACGATGATTTCCGGAACGTCTTAGACAGTGAGGATGAGATAGAGGAGCTGAGCAAGACCGTGGT
CCAGGTGGCAAAGAACCAGCATTTCGATGGCTTCGTGGTGGAGGTCTGGAACCAGCTGCTAAGCCAGAAG
CGCGTGGGCCTCATCCACATGCTCACCCACTTGGCCGAGGCTCTGCACCAGGCCCGGCTGCTGGCCCTCC
TGGTCATCCCGCCTGCCATCACCCCCGGGACCGACCAGCTGGGCATGTTCACGCACAAGGAGTTTGAGCA
GCTGGCCCCCGTGCTGGATGGTTTCAGCCTCATGACCTACGACTACTACAGCGCATCAGCCTGGCCCT
AATGCACCCCTGTCCTGGGTTCGAGCCTGCGTCCAGGTCCTGGACCCGAAGTCCAAGTGGCGAAGCAAAA
TCCTCCTGGGGCTCAACTTCTATGGTATGGACTACGCGACCTCCAAGGATGCCCGTGAGCCTGTTGTCGG
GGCCAGGTACATCCAGACACTGAAGGACCACAGGCCCCGGATGGTGTGGGACAGCCAGGCCTCAGAGCAC
TTCTTCGAGTACAAGAAGAGCCGCAGTGGGAGGCACGTCGTCTTCTACCCAACCCTGAAGTCCCTGCAGG
TGCGGCTGGAGCTGGCCCGGGAGCTGGGCGTTGGGGTCTCTATCTGGGAGCTGGGCCAGGGCCTGGACTA
CTTCTACGACCTGCTCTAGGTGGGCATTGCGGCCTCCGCGGTGGACGTGTTCTTTTCTAAGCCATGGAGT
GAGTGAGCAGGTGTGAAATACAGGCCTCCACTCCGTTTGCTGTGAAAAAAAAAAAAAAAAAAAAAAAAAA
AAAAAAAAAAAAAAAAAAAAAAAAAAAA >gi|12652724|gb|BC000112.1| Homo sapiens retinol dehydrogenase 11 (all-trans/9-
cis/11-cis), mRNA (cDNA clone MGC:704 IMAGE:3504920), complete cds
GGCAGAGATGGTTGAGCTCATGTTCCCGCTGTTGCTCCTCCTTCTGCCCTTCCTTCTGTATATGGCTGCG
CCCCAAATCAGGAAATGCTGTCCAGTGGGGTGTGTACATCAACTGTTCAGCTTCCTGGGAAAGTAGTTG
TGGTCACAGGAGCTAATACAGGTATCGGGAAGGAGACAGCCAAAGAGCTGGCTCAGAGAGGAGCTCGAGT
ATATTTAGCTTGCCGGGATGTGGAAAAGGGGGAATTGGTGGCCAAAGAGATCCAGACCACGACAGGGAAC
CAGCAGGTGTTGGTGCGGAAACTGGACCTGTCTGATACTAAGTCTATTCGAGCTTTTGCTAAGGGCTTCT
TAGCTGAGGAAAAGCACCTCCACGTTTTGATCAACAATGCAGGAGTGATGATGTGTCCGTACTCGAAGAC
AGCAGATGGCTTTGAGATGCACATAGGAGTCAACCACTTGGGTCACTTCCTCCTAACCCATCTGCTGCTA
GAGAAACTAAAGGAATCAGCCCCATCAAGGATAGTAAATGTGTCTTCCCTCGCACATCACCTGGGAAGGA
TCCACTTCCATAACCTTCAGGGCGAGAAATTCTACAATGCAGGCCTGGCCTACTGTCACAGCAAGCTAGC
CAACATCCTCTTCACCCAGGAACTGGCCCGGAGACTAAAAGGCTCTGGCGTTACGACGTATTCTGTACAC
CCTGGCACAGTCCAATCTGAACTGGTTCGGCACTCATCTTTCATGAGATGGATGTGGTGGCTTTTCTCCT
TTTTCATCAAGACTCCTCAGCAGGGAGCCCAGACCAGCCTGCACTGTGCCTTAACAGAAGGTCTTGAGAT

Figure 20 (Continued)

```
TCTAAGTGGGAATCATTTCAGTGACTGTCATGTGGCATGGGTCTCTGCCCAAGCTCGTAATGAGACTATA
GCAAGGCGGCTGTGGGACGTCAGTTGTGACCTGCTGGGCCTCCCAATAGACTAACAGGCAGTGCCAGTTG
GACCCAAGAGAAGACTGCAGCAGACTACACAGTACTTCTTGTCAAAATGATTCTCCTTCAAGGTTTTCAA
AACCTTTAGCACAAAGAGAGCAAAACCTTCCAGCCTTGCCTGCTTGGTGTCCAGTTAAAACTCAGTGTAC
TGCCAGATTCGTCTAAATGTCTGTCATGTCCAGATTTACTTTGCTTCTGTTACTGCCAGAGTTACTAGAG
ATATCATAATAGGATAAGAAGACCCTCATATGACCTGCACAGCTCATTTTCCTTCTGAAAGAAACTACTA
CCTAGGAGAATCTAAGCTATAGCAGGGATGATTTATGCAAATTTGAACTAGCTTCTTTGTTCACAATTCA
GTTCCTCCCAACCAACCAGTCTTCACTTCAAGAGGGCCACACTGCAACCTCAGCTTAACATGAATAACAA
AGACTGGCTCAGGAGCAGGGCTTGCCCAGGCATGGTGGATCACCGGAGGTCAGTAGTTCAAGACCAGCCT
GGCCAACATGGTGAAACCCCACCTCTACTAAAAATTGTGTATATCTTTGTGTGTCTTCCTGTTTATGTGT
GCCAAGGGAGTATTTTCACAAAGTTCAAAACAGCCACAATAATCAGAGATGGAGCAAACCAGTGCCATCC
AGTCTTTATGCAAATGAAATGCTGCAAAGGGAAGCAGATTCTGTATATGTTGGTAACTACCCACCAAGAG
CACATGGGTAGCAGGGAAGAAGTAAAAAAAAGAGAAGGAGAATACTGGAAGATAATGCACAAAATGAAGG
GACTAGTTAAGGATTAACTAGCCCTTTAAGGATTAACTAGTTAAGGATTAATAGCAAAAGATATTAAATA
TGCTAACATAGCTATGGAGGAATTGAGGGCAAGCACCCAGGACTGATGAGGTCTTAACAAAAACCAGTGT
GGCAAAAAAAAAAAAAAAAAAAAAAAAAAAAAAAAAAAAAAAAAA

>gi|33990673|gb|BC000633.2| Homo sapiens TTK protein kinase, mRNA (cDNA clone
MGC:865 IMAGE:3343925), complete cds
GGAAATTCAAACGTGTTTGCGGAAAGGAGTTTGGGTTCCATCTTTTCATTTCCCCAGCGCAGCTTTCTGT
AGAAATGGAATCCGAGGATTTAAGTGGCAGAGAATTGACAATTGATTCCATAATGAACAAAGTGAGAGAC
ATTAAAAATAAGTTTAAAAATGAAGACCTTACTGATGAACTAAGCTTGAATAAAATTTCTGCTGATACTA
CAGATAACTCGGGAACTGTTAACCAAATTATGATGATGGCAAACAACCCAGAGGACTGGTTGAGTTTGTT
GCTCAAACTAGAGAAAAACAGTGTTCCGCTAAGTGATGCTCTTTTAAATAAATTGATTGGTCGTTACAGT
CAAGCAATTGAAGCGCTTCCCCCAGATAAATATGGCCAAAATGAGAGTTTTGCTAGAATTCAAGTGAGAT
TTGCTGAATTAAAAGCTATTCAAGAGCCAGATGATGCACGTGACTACTTTCAAATGGCCAGAGCAAACTG
CAAGAAATTTGCTTTTGTTCATATATCTTTTGCACAATTTGAACTGTCACAAGGTAATGTCAAAAAAAGT
AAACAACTTCTTCAAAAAGCTGTAGAACGTGGAGCAGTACCACTAGAAATGCTGGAAATTGCCCTGCGGA
ATTTAAACCTCCAAAAAAAGCAGCTGCTTTCAGAGGAGGAAAAGAAGAATTTATCAGCATCTACGGTATT
AACTGCCCAAGAATCATTTTCCGGTTCACTTGGGCATTTACAGAATAGGAACAACAGTTGTGATTCCAGA
GGACAGACTACTAAAGCCAGGTTTTTATATGGAGAGAACATGCCACCACAAGATGCAGAAATAGGTTACC
GGAATTCATTGAGACAAACTAACAAAACTAAACAGTCATGCCCATTTGGAAGAGTCCCAGTTAACCTTCT
AAATAGCCCAGATTGTGATGTGAAGACAGATGATTCAGTTGTACCTTGTTTTATGAAAAGACAAACCTCT
AGATCAGAATGCCGAGATTTGGTTGTGCCTGGATCTAAACCAAGTGGAAATGATTCCTGTGAATTAAGAA
ATTTAAAGTCTGTTCAAAATAGTCATTTCAAGGAACCTCTGGTGTCAGATGAAAAGAGTTCTGAACTTAT
TATTACTGATTCAATAACCCTGAAGAATAAAACGGAATCAAGTCTTCTAGCTAAATTAGAAGAAACTAAA
GAGTATCAAGAACCAGAGGTTCCAGAGAGTAACCAGAAACAGTGGCAATCTAAGAGAAAGTCAGAGTGTA
TTAACCAGAATCCTGCTGCATCTTCAAATCACTGGCAGATTCCGGAGTTAGCCCGAAAAGTTAATACAGA
GCAGAAACATACCACTTTTGAGCAACCTGTCTTTTCAGTTTCAAAACAGTCACCACCAATATCAACATCT
AAATGGTTTGACCCAAAATCTATTTGTAAGACACCAAGCAGCAATACCTTGGATGATTACATGAGCTGTT
TTAGAACTCCAGTTGTAAAGAATGACTTTCCACCTGCTTGTCAGTTGTCAACACCTTATGGCCAACCTGC
```

Figure 20 (Continued)

CTGTTTCCAGCAGCAACAGCATCAAATACTTGCCACTCCACTTCAAAATTTACAGGTTTTAGCATCTTCT
TCAGCAAATGAATGCATTTCGGTTAAAGGAAGAATTTATTCCATTTTAAAGCAGATAGGAAGTGGAGGTT
CAAGCAAGGTATTTCAGGTGTTAAATGAAAAGAAACAGATATATGCTATAAAATATGTGAACTTAGAAGA
AGCAGATAACCAAACTCTTGATAGTTACCGGAACGAAATAGCTTATTTGAATAAACTACAACAACACAGT
GATAAGATCATCCGACTTTATGATTATGAAATCACGGACCAGTACATCTACATGGTAATGGAGTGTGGAA
ATATTGATCTTAATAGTTGGCTTAAAAAGAAAAAATCCATTGATCCATGGGAACGCAAGAGTTACTGGAA
AAATATGTTAGAGGCAGTTCACACAATCCATCAACATGGCATTGTTCACAGTGATCTTAAACCAGCTAAC
TTTCTGATAGTTGATGGAATGCTAAAGCTAATTGATTTTGGGATTGCAAACCAAATGCAACCAGATACAA
CAAGTGTTGTTAAAGATTCTCAGGTTGGCACAGTTAATTATATGCCACCAGAAGCAATCAAAGATATGTC
TTCCTCCAGAGAGAATGGGAAATCTAAGTCAAAGATAAGCCCCAAAAGTGATGTTTGGTCCTTAGGATGT
ATTTTGTACTATATGACTTACGGGAAAACACCATTTCAGCAGATAATTAATCAGATTTCTAAATTACATG
CCATAATTGATCCTAATCATGAAATTGAATTTCCCGATATTCCAGAGAAAGATCTTCAAGATGTGTTAAA
GTGTTGTTTAAAAAGGGACCCAAAACAGAGGATATCCATTCCTGAGCTCCTGGCTCATCCCTATGTTCAA
ATTCAAACTCATCCAGTTAACCAAATGGCCAAGGGAACCACTGAAGAAATGAAATATGTTCTGGGCCAAC
TTGTTGGTCTGAATTCTCCTAACTCCATTTTGAAAGCTGCTAAAACTTTATATGAACACTATAGTGGTGG
TGAAAGTCATAATTCTTCATCCTCCAAGACTTTTGAAAAAAAAGGGGAAAAAAATGATTTGCAGTTATT
CGTAATGTCAAATACCACCTATAAAATATATTGGACTGTTATACTCTTGAATCCCTGTGGAAATCTACAT
TTGAAGACAACATCACTCTGAAGTGTTATCAGCAAAAAAATTCAGTAGATTATCTTTAAAAGAAAACTG
TAAAAATAGCAACCACTTATGGTACTGTATATATTGTAGACTTGTTTTCTCTGTTTTATGCTCTTGTGTA
ATCTACTTGACATCATTTTACTCTTGGAATAGTGGGTGGATAGCAAGTATATTCTAAAAAACTTTGTAAA
TAAAGTTTTGTGGCTAAAATGACACTAAAAAAAAAAAAAAAAAAA

>gi|33875686|gb|BC000651.2| Homo sapiens solute carrier family 1 (glutamate
transporter), member 7, mRNA (cDNA clone IMAGE:3342757), complete cds
CTCTAAGGCGGCCACACGGGCATGGCCGTGGGGCTGGCGACTGGTGTTTAGCAACTCCGACCACCTGCCT
GCTGAGGGGCTAGAGCCCTCAGCCCAGACCCTGTGCCCCGGCCGGGCTCTCATGCGTGGAATGGTGCTG
TGCCCCTTGCCAGCAGGCCAGGCTCACCATGGTGCCGCATGCCATCTTGGCACGGGGGAGGGACGTGTGC
AGGCGGAATGGACTCCTCATCCTGTCTGTGCTGTCTGTCATCGTGGGCTGCCTCCTCGGCTTCTTCTTGA
GGACCCGGCGCCTCTCACCACAGGAAATTAGTTACTTCCAGTTCCCTGGAGAGCTCCTGATGAGGATGCT
GAAGATGATGATCCTGCCACTGGTGGTCTCCAGCTTGATGTCCGGACTTGCCTCCCTGGATGCCAAGACC
TCTAGCCGCCTGGGCGTCCTCACCGTGGCGTACTACCTGTGGACCACCTTCATGGCTGTCATCGTGGGCA
TCTTCATGGTCTCCATCATCCACCCAGGCAGCGCGGCCCAGAAGGAGACCACGGAGCAGAGTGGGAAGCC
CATCATGAGCTCAGCCGATGCCCTGTTGGACCTCATCCGGCAGAAAGAAGAAAGTTGGAGGAACGGACCA
AAGGGTCCTGGCTGAATGGGCACCTCCTTAAGAGTTTTCCAGGAATCACCACCCAACGACTTCCACTCAC
CTCTCGATGGCCACCCCATTAGCAAGAGAATCAGAGCTTGATGGCAGGTCCCATTTGGTCCCCACAACAT
AATAGGACTTCTATTAAGGAAGGACGGGAGAATGGAGACTGCATAGGCAACTAGCTGTCTCTGCCAAGGC
CCACATTTAAAATGATTGTAATTGTAAAGGAAGTTGTAAAGAAATGTCTATATAGGTATAAGTTCCATTT
GGCTTCTTACGAGCTTCCAAATGTTCTCCGTGTGTGTAAACTGAGTCTTGAAAGAGGGGAAGAGGGTTAC
CGAGGACAAGAGTGAGTGGGAGGCGACCCAGGTGGAGGCAGTGTGAGTGTGGGCGGCAGGTTGGAGGAA
GAGCAGGCATGCAACGGAAGCCTCTTACCAGATGCTCACCTCAGAGTTGGCATTTCTCACAAGACACACT
CCTAGAAGGGACTGTGAAGACAAAGATACAAATGCTTTTAGAGAAAGGTTGCTGCCAGGACCATGTGAG
GGTGCCCATCTCACCAAACCTCCCACATTGTGCACTGTCATTTGAAAAATACTTTGTCAGTTTGACAGGT

Figure 20 (Continued)

GGAAATATCTTGAATTTGTTGATGAAACTAAACATTTTAAAAAGCAAAAAAAAAAAAAAAAAAAAAAAA
AAAAAAAAAA

>gi|12654112|gb|BC000870.1| Homo sapiens TIMELESS interacting protein, mRNA (cDNA
clone MGC:4958 IMAGE:3460338), complete cds
GCGCTTAGTCTGCACGCCGAGGTCCGCGCTGTGTCCCGTGTTTTCTGCGTGAGAGGAAAAGATGCTAGAA
CCACAGGAGAATGGCGTGATTGACCTACCAGATTATGAGCATGTAGAAGATGAAACTTTTCCTCCTTTCC
CACCTCCAGCCTCTCCAGAGAGACAAGATGGTGAAGGAACTGAGCCTGATGAAGAGTCAGGAAATGGAGC
ACCTGTTCCTGTACCTCCAAAGAGAACAGTTAAAAGAAATATACCCAAGCTGGATGCTCAGAGATTAATT
TCAGAGAGAGGACTTCCAGCCTTAAGGCATGTATTTGATAAGGCAAAATTCAAAGGTAAAGGTCATGAGG
CTGAAGACTTGAAGATGCTAATCAGACACATGGAGCACTGGGCACATAGGCTATTCCCTAAACTGCAGTT
TGAGGATTTTATTGACAGAGTTGAATACCTGGGAAGTAAAAAGGAAGTTCAGACCTGTTTAAAACGAATT
CGACTTGATCTCCCTATTTTACATGAAGATTTTGTTAGCAATAATGATGAAGTTGCGGAGAATAATGAAC
ATGATGTCACTTCTACTGAATTAGATCCCTTTCTGACAAACTTATCTGAAAGTGAGATGTTTGCTTCTGA
GTTAAGTAGAAGCCTAACAGAAGAGCAACAACAAAGAATTGAGAGAAATAAACAACTGGCCTTGGAAAGA
AGGCAGGCAAAGCTGCTGAGTAATAGTCAGACCCTAGGAAATGATATGTTAATGAATACACCCAGGGCAC
ACACGGTTGAAGAGGTTAATACTGATGAGGATCAAAAGGAGGAGTCAAATGGATTAAACGAAGACATTCT
GGACAATCCATGTAATGATGCTATTGCCAATACTTTAAATGAAGAGGAAACACTGCTGGACCAGTCTTTT
AAAAATGTGCAACAGCAACTTGATGCTACATCCAGAAATATTACTGAAGCTAGATAAGTTTCCATTAAGA
GAAAATGTATCTGTTAAGTCATCGTCCTGCAAGCTTGGCGTTACTATGTATTTTTCTTCTTGGAGTGAA
AATCCTTAGATAGTAAAACTGTTATAGATTATTGTTTAAAAAAAAAAAAAAAAAAAAAAAA >gi|37515273|gb|BC001408.2| Homo sapiens cDNA clone IMAGE:3139680, containing
frame-shift errors
GCAGCGCGGAGCCCGGCTCGGCCACACCGATCGCCCGCCGCCATGGGCTCCTCGCAAAGCGTCGAGATCC
CGGGCGGGGGCACCGAGGGCTACCACGTTCTGCGGGTACAAGAAAATTCCCCAGGACACAGAGCTGGTTT
GGAGCCTTTCTTTGATTTTATTGTTTCTATTAATGGTTCAAGATTAAATAAAGACAATGACACTCTTAAG
GATCTGCTGAAAGCAAACGTTGAAAAGCCTGTAAAGATGCTTATCTATAGCAGCAAAACATTGGAACTGC
GAGAGACCTCAGTCACACCAAGTAACCTGTGGGGCGGCCAGGGCTTATTGGGAGTGAGCATTCGTTTCTG
CAGCTTTGATGGGCAAATGAAAATGTTTGGCATGTGCTGGAGGTGGAATCAAATTCTCCTGCAGCACTG
GCAGGTCTTAGACCACACAGTGATTATATAATTGGAGCAGATACAGTCATGAATGAGTCTGAAGATCTAT
TCAGCCTTATCGAAACACATGAAGCAAAACCATTGAAACTGTATGTGTACAACACAGACACTGATAACTG
TCGAGAAGTGATTATTACACCAAATTCTGCATGGGTGGAGAAGGCAGCCTAGGATGTGGCATTGGATAT
GGTTATTTGCATCGAATACCTACACGCCCATTTGAGGAAGGAAAGAAAATTTCTCTTCCAGGACAAATGG
CTGGTACACCTATTACACCTCTTAAAGATGGGTTTACAGAGGTCCAGCTGTCCTCAGTTAATCCCCGTC
TTTGTCACCACCAGGAACTACAGGAATTGAACAGAGTCTGACTGGACTTTCTATTAGCTCAACTCCACCA
GCTGTCAGTAGTGTTCTCAGTACAGGTGTACCAACAGTACCGTTATTGCCACCACAAGTAAACCAGTCCC
TCACTTCTGTGCCACCAATGAATCCAGCTACTACATTACCAGGTCTGATGCCTTTACCAGCAGGACTGCC
CAACCTCCCCAACCTCAACCTCAACCTCCCAGCACCACACATCATGCCAGGGGTTGGCTTACCAGAACTT
GTAAACCCAGGTCTGCCACCTCTTCCTTCCATGCCTCCCCGAAACTTACCTGGCATTGCACCTCTCCCCC
TGCCATCCGAGTTCCTCCCGTCATTCCCCTTGGTTCCAGAGAGCTCTTCTGCAGCAAGCTCAGGAGAGCT
GCTGTCTTCCCTCCCGCCCACCAGCAACGCACCCTCTGACCCTGCCACAACTACTGCAAAGGCAGACGCT

Figure 20 (Continued)

```
GCCTCCTCACTCACTGTGGATGTGACGCCCCCACTGCCAAGGCCCCCACCACCGTTAGGACAGAGTCGG
CGACTCCACCCCAGTCAGCGAGAAGCCTGTTTCTGCGGCTGTGGATGCCAATGCTTCTGAGTCACCTTAA
CTTTGAACCATTCTTTGGAATTGGCGTGGTATATTTAACCACGGGAGCGTGTCTGGAAACGCAAACTATC
ATTAATTTCATACTAGTTTGTACCGTATCTGTAGGCATCCTGTAAATAATTCCAAGGGGAAAACTAAACG
AGGACGTGGGTTGTATCCTGCCAGGTTGAGTGGGGCTCACACGCTAGGGTGAGATGTCAGAAAGCGCTTG
TATTTTAAACAACCAAAAAGAATTGTAAGGGTGGCTTGCTGCCAGGCTTGCACTGCCGTTCCTGGGGGTG
TGCATCTTCGGGAAAGGTGGTGGCGGGGCGTCCACTAGGTTTCCTGTCCCCTGCTGCTCCTTCCGTAAGA
AAATGAAATATTCTATGCCTAATACTCACACGCAACATTTCTTGTACTTTGTAAGTCGTTTGCGAGAATG
CAGACCACCTCACTAAACTGTAAACGGTAAAGAGATTTTTACTTTTGGTCTCCGTGAGTCGCATCTCTAC
TAAGGTTTACACAGGAATTCCACCTGAAGACTTGTGTTAAAGTTCTACAGCGCGCACTGTTAACTGAACG
TCTTTTTCTTCAGCCTATACGCGGATCCTTGTTTTGAGCTCTCAGAATCACTCAGACAACATTTTGTAAC
TGCTGCTGTTGCTTTCTACATACACCTTATAAAGTGACATTTCAAAAGAAATAAGGTGCCACAGTTTTAA
ACCAGAAGGTGGCACTCTGTGGCTCCTTGTAGTATTATAGCTATACTGGGAAAGCATAGATACAGCAATA
AAGTACAGTAATTTTACTTTTTTTCTTGTGTTACATCTAAATTACAACCCTTAATTGCCACGTGTGCACT
TACTACTCTCCAGTATGTCTTATTACTCTCCAGTATGTCACGCATCTTTAACTTTTCACGTCCTATGTTT
GCTTTCTCCCATTTTTAAGAGATGGTAAGTTAACTGGAATTGATTTACTGAATGAAATTAAATGCAGATA
TCCCTGTTTTTGAAATAAAAAAAAAAAAAAAAAAA

>gi|34783904|gb|BC001454.2|  Homo sapiens phosphoenolpyruvate carboxykinase 2
(mitochondrial), mRNA (cDNA clone MGC:1492 IMAGE:3138368), complete cds
CCGCCTTCCATACCTCCCCGGCTCCGCTCGGTTCCTGGCCACCCCGCAGCCCCTGCCCAGGTGCCATGGC
CGCATTGTACCGCCCTGGCCTGCGGCTTAACTGGCATGGGCTGAGCCCCTTGGGCTGGCCATCATGCCGT
AGCATCCAGACCCTGCGAGTGCTTAGTGGAGATCTGGGCCAGCTTCCCACTGGCATTCGAGATTTTGTAG
AGCACAGTGCCCGCCTGTGCCAACCAGAGGGCATCCACATCTGTGATGGAACTGAGGCTGAGAATACTGC
CACACTGACCCTGCTGGAGCAGCAGGGCCTCATCCGAAAGCTCCCCAAGTACAATAACTGCTGGCTGGCC
CGCACAGACCCCAAGGATGTGGCACGAGTAGAGAGCAAGACGGTGATTGTAACTCCTTCTCAGCGGGACA
CGGTACCACTCCCGCCTGGTGGGGCCCGTGGGCAGCTGGGCAACTGGATGTCCCCAGCTGATTTCCAGCG
AGCTGTGGATGAGAGGTTTCCAGGCTGCATGCAGGGCCGCACCATGTATGTGCTTCCATTCAGCATGGGT
CCTGTGGGCTCCCCGCTGTCCCGCATCGGGGTGCAGCTCACTGACTCAGCCTATGTGGTGGCAAGCATGC
GTATTATGACCCGACTGGGGACACCTGTGCTTCAGGCCCTGGGAGATGGTGACTTTGTCAAGTGTCTGCA
CTCCGTGGGCCAGCCCCTGACAGGACAAGGGGAGCCAGTGAGCCAGTGGCCGTGCAACCCAGAGAAAACC
CTGATTGGCCACGTGCCCGACCAGCGGGAGATCATCTCCTTCGGCAGCGGCTATGGTGGCAACTCCCTGC
TGGGCAAGAAGTGCTTTGCCCTACGCATCGCCTCTCGGCTGGCCCGGGATGAGGGCTGGCTGGCAGAGCA
CATGCTGATCCTGGGCATCACCAGCCCTGCAGGGAAGAAGCGCTATGTGGCAGCCGCCTTCCCTAGTGCC
TGTGGCAAGACCAACCTGGCTATGATGCGGCCTGCACTGCCAGGCTGGAAAGTGGAGTGTGTGGGGGATG
ATATTGCTTGGATGAGGTTTGACAGTGAAGGTCGACTCCGGGCCATCAACCCTGAGAACGGCTTCTTTGG
GGTTGCCCCTGGTACCTCTGCCACCACCAATCCCAACGCCATGGCTACAATCCAGAGTAACACTATTTTT
ACCAATGTGGCTGAGACCAGTGATGGTGGCGTGTACTGGGAGGGCATTGACCAGCCTCTTCCACCTGGTG
TTACTGTGACCTCCTGGCTGGGCAAACCCTGGAAACCTGGTGACAAGGAGCCCTGTGCACATCCCAACTC
TCGATTTTGTGCCCCGGCTCGCCAGTGCCCCATCATGGACCCAGCCTGGGAGGCCCCAGAGGGTGTCCCC
ATTGACGCCATCATCTTTGGTGGCCGCAGACCCAAAGGGGTACCCCTGGTATACGAGGCCTTCAACTGGC
GTCATGGGGTGTTTGTGGGCAGCGCCATGCGCTCTGAGTCCACTGCTGCAGCAGAACACAAAGGGAAGAT
```

Figure 20 (Continued)

```
CATCATGCACGACCCATTTGCCATGCGGCCCTTTTTTGGCTACAACTTCGGGCACTACCTGGAACACTGG
CTGAGCATGGAAGGGCGCAAGGGGGCCCAGCTGCCCCGTATCTTCCATGTCAACTGGTTCCGGCGTGACG
AGGCAGGGCACTTCCTGTGGCCAGGCTTTGGGGAGAATGCTCGGGTGCTAGACTGGATCTGCCGGCGGTT
AGAGGGGGAGGACAGTGCCCGAGAGACACCCATTGGGCTGGTGCCAAAGGAAGGAGCCTTGGATCTCAGC
GGCCTCAGAGCTATAGACACCACTCAGCTGTTCTCCCTCCCCAAGGACTTCTGGGAACAGGAGGTTCGTG
ACATTCGGAGCTACCTGACAGAGCAGGTCAACCAGGATCTGCCCAAAGAGGTGTTGGCTGAGCTTGAGGC
CCTGGAGAGACGTGTGCACAAAATGTGACCTGAGGCCCTAGTCTAGCAAGAGGACATAGCACCCTCATCT
GGGAATAGGGAAGGCACCTTGCAGAAAATATGAGCAATTTGATATTAACTAACATCTTCAATGTGCCATA
GACCTTCCCACAAAGACTGTCCAATAATAAGAGATGCTTATCTATTTTAAAAAAAAAAAAAAAAAAAAAA
AA

>gi|33876749|gb|BC002488.2| Homo sapiens SERPINE1 mRNA binding protein 1, mRNA
(cDNA clone MGC:1357 IMAGE:3051198), complete cds
AGCAGGCGCTCTTGGCTCGGCGCGGCCCGCTGCAATCCGTGGAGGAACGCGCCGCCGAGCCACCATCATG
CCTGGGCACTTACAGGAAGGCTTCGGCTGCGTGGTCACCAACCGATTCGACCAGTTATTTGACGACGAAT
CGGACCCCTTCGAGGTGCTGAAGGCAGCAGAGAACAAGAAAAAAGAAGCCGGCGGGGCGGCGTTGGGGG
CCCTGGGGCCAAGAGCGCAGCTCAGGCCGCGGCCCAGACCAACTCCAACGCGGCAGGCAAACAGCTGCGC
AAGGAGTCCCAGAAAGACCGCAAGAACCCGCTGCCCCCAGCGTTGGCGTGGTTGACAAGAAAGAGGAGA
CGCAGCCGCCCGTGGCGCTTAAGAAAGAAGGAATAAGACGAGTTGGAAGAAGACCTGATCAACAACTTCA
GGGTGAAGGGAAAATAATTGATAGAAGACCAGAAAGGCGACCACCTCGTGAACGAAGATTCGAAAAGCCA
CTTGAAGAAAAGGGTGAAGGAGGCGAATTTTCAGTTGATAGACCGATTATTGACCGACCTATTCGAGGTC
GTGGTGGTCTTGGAAGAGGTCGAGGGGGCCGTGGACGTGGAATGGGCCGAGGAGATGGATTTGATTCTCG
TGGCAAACGTGAATTTGATAGGCATAGTGGAAGTGATAGATCTGGCCTGAAGCACGAGGACAAACGTGGA
GGTAGCGGATCTCACAACTGGGGAACTGTCAAAGACGAATTAACAGAGTCCCCCAAATACATTCAGAAAC
AAATATCTTATAATTACAGTGACTTGGATCAATCAAATGTGACTGAGGAAACACCTGAAGGTGAAGAACA
TCATCCAGTGGCAGACACTGAAAATAAGGAGAATGAAGTTGAAGAGGTAAAAGAGGAGGGTCCAAAAGAG
ATGACTTTGGATGAGTGGAAGGCTATTCAAAATAAGGACCGGGCAAAAGTAGAATTTAATATCCGAAAAC
CAAATGAAGGTGCTGATGGGCAGTGGAAGAAGGGATTTGTTCTTCATAAATCAAAGAGTGAAGAGGCTCA
TGCTGAAGATTCGGTTATGGACCATCATTTCCGGAAGCCAGCAAATGATATAACGTCTCAGCTGGAGATC
AATTTTGGAGACCTTGGCCGCCCAGGACGTGGCGGCAGGGGAGGACGAGGTGGATGTGGGCGTGGTGGGC
GCCCAAACCGTGGCAGCAGGACCGACAAGTCAAGTGCTTCTGCTCCTGATGTGGATGACCCAGAGGCATT
CCCAGCTCTGGCTTAACTGGATGCCATAAGACAACCCTGGTTCCTTTGTGAACCCTTCTGTTCAAAGCTT
TTGCATGCTTAAGGATTCCAAACGACTAAGAAATTAAAAAAAAAAAAGACTGTCATTCATACCATTCACA
CCTAAAGACTGAATTTTATCTGTTTTAAAAATGAACTTCTCCCGCTACACAGAAGTAACAAATATGGTAG
TCAGTTTTGTATTTAGAAATGTATTGGTAGCAGGGATGTTTTCATAATTTTCAGAGATTATGCATTCTTC
ATGAATACTTTTGTATTGCTGCTTGCAAATATGCATTTCCAAACTTGAAATATAGGTGTGAACAGTGTGT
ACCAGTAAAAAAAAAAAAAAAAAAAAAAAAAAAAAAAAAAAAAAAA >gi|33877313|gb|BC002897.2| Homo sapiens zinc finger protein 343, mRNA (cDNA
clone IMAGE:3940750), complete cds
CCTCGTGCCGATTCGGCACGAGGCCCGGGCACGCTGGCTCTGGTCCACCTTCTCCAATCCCTGCCTGCTG
GGAGAGGACGATCTCTTGAGAAAGGAAAGACTTCTGTGCTCCCGAGAACTTCCTATCAGGTCCTGGCTGC
```

Figure 20 (Continued)

```
AGGGAAACAAGCTGGGCTTTTTATAATTAAGGTTGGAAGAAGTCACCACAGGCAGCAGAACTCCATCTTG
AGATGAAATAACATCTACCTGGACCTCTGGCAGAATTTCAAGGCACACACTGGGCTGACTCTGGCGCCAT
GATGTTGCCTTATCCTTCAGCACTGGGAGATCAATACTGGGAAGAGATTTTGCTTCCAAAGAATGGGGAA
AATGTAGAGACTATGAAGAAATTGACCCAAAATCATAAAGCGAAAGGCTTGCCTTCTAATGATACTGACT
GCCCCCAGAAAAGGAGGGAAAGGCCCAAATAGTGGTACCAGTTACATTCAGGGATGTGACTGTGATCTT
CACAGAAGCAGAATGGAAGAGACTGAGTCCAGAGCAGAGGAATCTATACAAAGAAGTGATGCTGGAGAAT
TACAGGAATCTTCTCTCATTGGGTCAGGAGATCGAGACCATCCTGGCCAACATAGTGAAATCCCATCTCT
ACTAAAAATACAAAAATTAGCTGAGCATGGTGGCATGTGCCTGTAATCTCAGCTACTTGGGAGCCTGAGG
CAGGAGAATCACTTGAACCAGGGAGTCAGAGGTTGCAGTGAGCCGAGATTGTGCCGTTGCACTCCAGCCT
GGTGACAGAGTGAAACTCAGTCTGAAAAAATAAAAAAAAATAAAAAAATATTTAAAAAAAAAAAAAAAA
AAAAAAA
```

```
>gi|13097692|gb|BC003555.1| Homo sapiens nucleolar complex associated 2 homolog
(S. cerevisiae), mRNA (cDNA clone MGC:1451 IMAGE:3546209), complete cds
CGGAAGTGGGGTGCACGCTTCGGGTTGGTGTCATGGCAGCTGCGGGGAGCCGCAAGAGGCGCCTGGCGGA
GCTGACGGTGGACGAGTTCCTAGCTTCGGGCTTTGACTCCGAGTCCGAATCCGAGTCCGAAAATTCTCCA
CAAGCGGAGACACGGGAAGCACGCGAGGCTGCCCGGAGTCCGGATAAGCCGGGCGGGAGCCCCTCGGCCA
GCCGGCGTAAAGGCCGTGCCTCTGAGCACAAAGACCAGCTCTCTCGGCTGAAGGACAGAGACCCCGAGTT
CTACAAGTTCCTGCAGGAGAATGACCAGAGCCTGCTAAACTTCAGCGACTCGGACAGCTCTGAGGAGGAA
GAGGGGCCGTTCCACTCCCTGCCAGATGTGCTGGAGGAAGCCAGTGAGGAGGAGGATGGAGCGGAGGAAG
GAGAAGATGGGGACAGAGTCCCCAGAGGGCTGAAGGGGAAGAAGAATTCTGTTCCTGTGACCGTCGCCAT
GGTTGAGAGATGGAAGCAGGCAGCAAAGCAACGCCTCACTCCAAAGCTGTTCCATGAAGTGGTACAGGCG
TTCCGAGCAGCTGTGGCCACCACCCGAGGGGACCAGGAAAGTGCTGAGGCCAACAAATTCCAGGTCACGG
ACAGTGCTGCATTCAATGCTCTGGTTACCTTCTGCATCAGAGACCTCATTGGCTGTCTCCAGAAGCTGCT
GTTTGGAAAGGTGGCAAAGGATAGCAGCAGGATGCTGCAGCCGTCCAGCAGCCCGCTCTGGGGGAAGCTT
CGTGTGGACATCAAGGCTTACCTGGGCTCGGCCATACAGCTGGTGTCCTGTCTGTCGGAGACGACGGTGT
TGGCGGCCGTGCTGCGGCACATCAGCGTGCTGGTGCCCTGCTTCCTGACCTTCCCCAAGCAGTGCCGCAT
GCTGCTCAAGAGAATGGTGGTCGTATGGAGCACTGGGGAGGAGTCTCTGCGGGTGCTGGCTTTCCTGGTC
CTCAGCAGAGTCTGCCGGCACAAGAAGGACACTTTCCTTGGCCCCGTCCTCAAGCAAATGTACATCACGT
ATGTGAGGAACTGCAAGTTCACCTCGCCTGGTGCCCTCCCCTTCATCAGTTTCATGCAGTGGACCTTGAC
GGAGCTGCTGGCCCTGGAGCCGGGTGTGGCCTACCAGCACGCCTTCCTCTACATCCGCCAGCTCGCCATA
CACCTGCGCAACGCCATGACCACCCGCAAGAAGGAAACATACCAGTCTGTGTACAACTGGCAGTATGTGC
ACTGCCTCTTCCTGTGGTGCCGGGTCCTGAGCACTGCGGGCCCCAGCGAAGCCCTCCAGCCCTTGGTCTA
CCCCCTTGCCCAAGTCATCATTGGCTGTATCAAGCTCATCCCCACTGCCCGCTTCTACCCGCTGCGAATG
CACTGCATCCGTGCCCTGACGCTGCTCTCGGGGAGCTCGGGGGCCTTCATCCCGGTGCTGCCTTTCATCC
TGGAGATGTTCCAGCAGGTCGACTTCAACAGGAAGCCAGGGCGCATGAGCTCCAAGCCCATCAACTTCTC
CGTGATCCTGAAGCTGTCCAATGTCAACCTGCAGGAGAAGGCGTACCGGGACGGCCTGGTGGAGCAGCTG
TACGACCTCACCCTGGAGTACCTGCACAGCCAGGCACACTGCATCGGCTTCCCGGAGCTGGTGCTGCCTG
TGGTCCTGCAGCTGAAGTCGTTCCTCCGGGAGTGCAAGGTGGCCAACTACTGCCGGCAGGTGCAGCAGCT
GCTTGGGAAGGTTCAGGAGAACTCGGCATACATCTGCAGCCGCCGCCAGAGGGTTTCCTTCGGCGTCTCT
GAGCAGCAGGCAGTGGAAGCCTGGGAGAAGCTGACCCGGGAAGAGGGGACACCCTTGACCTTGTACTACA
GCCACTGGCGCAAGCTGCGTGACCGGGAGATCCAGCTGGAGATCAGTGGCAAAGAGCGGCTGGAAGACCT
```

Figure 20 (Continued)

```
GAACTTCCCTGAGATCAAACGAAGGAAGATGGCTGACAGGAAGGATGAGGACAGGAAGCAATTTAAAGAC
CTCTTTGACCTGAACAGCTCTGAAGAGGACGACACCGAGGGATTCTCGGAGAGAGGGATACTGAGGCCCC
TGAGCACTCGGCATGGGGTGGAAGACGATGAAGAGGACGAGGAGGAGGGCGAGGAGGACAGCAGCAACTC
GGAGGATGGAGACCCAGACGCAGAGGCGGGGCTGGCCCCTGGGGAGCTGCAGCAGCTGGCCCAGGGGCCG
GAGGACGAGCTGGAGGATCTGCAGCTCTCAGAGGACGACTGAGGCAGCCCATCTGGGGGCCTGTAGGGG
CTGCCGGGCTGGTGGCCAGTGTTTCCACCTCCCTGGCAGTCAGGCCTAGAGGCTGGCGTCTGTGCAGTTG
GGGGAGGCAGTAGACACGGGACAGGCTTTATTATTTATTTTTCAGCATGAAAGACCAAACGTATCGAGAG
CTGGGCTGGGCTGGGCTGGTGTGGCTGCTGAAGCCCCACAGCTGTGGGCTGCTGAAGTCAGCTCCGCGGG
GGAGCTGACCCTGACGTCAGCAGACCGAGACCAGTCCCAGTTCCAGGGGAGGCCTGCAGGCCCCTGGCC
CCTTCCACCACCTCTGCCCTCCGTCTGCAGACCTCGTCCATCTGCACCAGGCTCTGCCTTCACTCCCCCA
AGTCTTTGGAAATTTGTTCTTTTCCTTTGAAGTCACATTTTCTTTTAAAATTTTTTGTTTTGCATCCGAA
ACCGAAAGAAATAAAGCGGTGGGAGGCAGGAAAAAAAAAAAAAAAAAAAAAAAAAAAAAAAAAAAAAAAA
A

>gi|33872695|gb|BC004101.2| Homo sapiens bridging integrator 1, mRNA (cDNA clone
MGC:10367 IMAGE:3688734), complete cds
GGCGCGCAAGATCTCCCCGCGCGAGAGCGGCCCTTGCCACCGGGCGAGGCCTGCGCCGCGATGGCAGAGA
TGGGCAGTAAAGGGGTGACGGCGGGAAAGATCGCCAGCAACGTGCAGAAGAAGCTCACCCGCGCGCAGGA
GAAGGTTCTCCAGAAGCTGGGGAAGGCAGATGAGACCAAGGATGAGCAGTTTGAGCAGTGCGTCCAGAAT
TTCAACAAGCAGCTGACGGAGGGCACCCGGCTGCAGAAGGATCTCCGGACCTACCTGGCCTCCGTCAAAG
CCATGCACGAGGCTTCCAAGAAGCTGAATGAGTGTCTGCAGGAGGTGTATGAGCCCGATTGGCCCGGCAG
GGATGAGGCAAACAAGATCGCAGAGAACAACGACCTGCTGTGGATGGATTACCACCAGAAGCTGGTGGAC
CAGGCGCTGCTGACCATGGACACGTACCTGGGCCAGTTCCCCGACATCAAGTCACGCATTGCCAAGCGGG
GGCGCAAGCTGGTGGACTACGACAGTGCCCGGCACCACTACGAGTCCCTTCAAACCGCCAAAAAGAAGGA
TGAAGCCAAAATTGCCAAGGCCGAGGAGGAGCTCATCAAAGCCCAGAAGGTGTTTGAGGAGATGAATGTG
GATCTGCAGGAGGAGCTGCCGTCCCTGTGGAACAGCCGCGTAGGTTTCTACGTCAACACGTTCCAGAGCA
TCGCGGGCCTGGAGGAAAACTTCCACAAGGAGATGAGCAAGCTCAACCAGAACCTCAATGATGTGCTGGT
CGGCCTGGAGAAGCAACACGGGAGCAACACCTTCACGGTCAAGGCCCAGCCCAGTGACAACGCGCCTGCA
AAAGGGAACAAGAGCCCTTCGCCTCCAGATGGCTCCCCTGCCGCCACCCCCGAGATCAGAGTCAACCACG
AGCCAGAGCCGGCTGGCGGGGCCACGCCCGGGCCACCCTCCCCAAGTCCCCATCTCAGCCAGCAGAGGC
CTCGGAGGTGGCGGGTGGGACCCAACCTGCGGCTGGAGCCCAGGAGCCAGGGGAGACGGCGGCAAGTGAA
GCAGCCTCCAGCTCTCTTCCTGCTGTCGTGGTGGAGACCTTCCCAGCAACTGTGAATGGCACCGTGGAGG
GCGGCAGTGGGGCCGGGCGCTTGGACCTGCCCCCAGGTTTCATGTTCAAGGTACAGGCCCAGCACGACTA
CACGGCCACTGACACAGACGAGCTGCAGCTCAGGGCTGGTGATGTGGTGCTGGTGATCCCCTTCCAGAAC
CCTGAAGAGCAGGATGAAGGCTGGCTCATGGGCGTGAAGGAGAGCGACTGGAACCAGCACAAGGAGCTGG
AGAAGTGCCGTGGCGTCTTCCCCGAGAACTTCACTGAGAGGGTCCCATGACGGCGGGGCCCAGGCAGCCT
CCGGGCGTGTGAAGAACACCTCCTCCCGAAAAATGTGTGGTTCTTTTTTTTGTTTGTTTTCGTTTTTCA
TCTTTTGAAGAGCAAAGGGAAATCAAGAGGAGACCCCAGGCAGAGGGCGTTCTCCCAAAGATTAGGTC
GTTTTCCAAAGAGCCGCGTCCCGGCAAGTCCGGCGGAATTCACCAGTGTTCCTGAAGCTGCTGTGTCCTC
TAGTTGAGTTTCTGGCGCCCCTGCCTGTGCCCGCATGTGTGCCTGGCCGCAGGGCGGGGCTGGGGCTGC
CGAGCCACCATGCTTGCCTGAAGCTTCGGCCGCGCCACCCGGGCAAGGGTCCTCTTTTCCTGGCAGCTGC
TGTGGGTGGGGCCCAGACACCAGCCTAGCCTGGCTCTGCCCCGCAGACGGTCTGTGTGCTGTTTGAAAAT
```

Figure 20 (Continued)

AAATCTTAGTGTTCAAAACAAAATGAAACAAAAAAAAAAAAAAAAA

>gi|39644692|gb|BC004514.2| Homo sapiens armadillo repeat containing 9, mRNA
(cDNA clone IMAGE:3929097), partial cds
AAAACCTACCTGGAGACCAAAGGGGCAGCCTTGAGCCAGACCACAGAGTTTCTTCCTTTCTATGCCCTTC
CTTTTGTTCCCAACCCTATGGTGCACCCCTCATTTAAAGAACTCTTCCAGGATTCCTGGACTCCAGAGTT
AAAGTTGAAGTTGGAAAAGTTTCTAGCTTTAATATCTAAAGCCAGCAACACGCCAAAGCTTTTAACAATA
TATAAGGAGAATGGACAAAGTAACAAAGAAATCTTGCAGCAGCTCCACCAGCAGCTGGTTGAAGCTGAAC
GTAGGTCAGTGACATACCTCAAACGGTACAATAAGATCCAGGCCGACTACCACAATCTCATTGGAGTCAC
AGCAGAGCTGGTGGATTCTCTAGAGGCCACAGTCAGCGGCAAGATGATCACCCCTGAGTACCTCCAGAGC
GTCTGTGTCCGCCTGTTCAGTAACCAGATGCGGCAGAGCCTGGCGCATAGTGTGGACTTCACGAGGCCTG
GGACGGCATCCACCATGTTACGAGCCTCCTTGGCACCCGTGAAATTGAAGGATGTCCCATTACTGCCCTC
CTTGGATTATGAGAAACTGAAGAAGGATTTGATTTTGGGGAGTGACCGCTTGAAAGCCTTCTTGTTGCAG
GCTCTGCGCTGGCGCTTGACCACATCCCATCCTGGAGAGCAGAGGGAGACCGTTCTGCAAGCCTACATCA
GCAATGACCTCTTGGACTGTTATAGCCACAACCAGAGGAGTGTGCTTCAGTTGCTGCACTCCACGAGCGA
CGTGGTGCGGCAGTACATGGCCAGGCTCATCAATGCTTTTGCGTCACTGGCAGAAGGTCGCCTCTACCTT
GCCCAGAACACAAAGGTGCTGCAGATGCTGGAGGGAAGGCTGAAGGAGGAGGACAAGGATATCATCACCA
GGGAGAATGTTCTTGGGGCCCTGCAGAAGTTCAGTCTCAGGCGCCCGCTGCAGACAGCGATGATTCAAGA
CGGCCTCATCTTCTGGCTGGTTGATGTTCTGAAGGACCCTGACTGCCTGTCTGACTACACGCTGGAGTAC
TCGGTGGCTTTGCTCATGAACCTCTGCCTCCGCAGCACAGGGAAGAACATGTGTGCCAAGGTGGCAGGCC
TCGTGCTCAAAGTCCTTTCGGATCTTCTTGGCCATGAAAACCATGAGATACAGCCGTATGTGAATGGAGC
TCTGTACAGCATCCTTTCTGTTCCATCCATTCGTGAGGAAGCAAGAGCAATGGGAATGGAAGACATCCTA
CGCTGCTTCATCAAAGAAGGCAATGCTGAAATGATCCGCCAGATAGAATTCATCATCAAGCAGCTAAATT
CCGAAGAGCTACCAGATGGTGTTCTTGAATCTGATGATGATGAAGATGAAGATGATGAAGAGGACCATGA
CATCATGGAAGCCGATCTGGACAAAGACGAACTGATCCAGCCCCAGCTTGGAGAACTCTCAGGAGAGAAG
CTTCTGACCACAGAGTACCTGGGGATCATGACCAACACGGGGAAGACAAGGCGGAAGGGGCTGGCTAATG
TGCAGTGGAGCGGGGATGAGCCCCTGCAAAGGCCCGTCACCCCCGGCGGCCACAGAAACGGGTACCCAGT
GTAAGTCAGGGCTAAAGGAAGCGGGAATTGACTTTCTTAAGCTTTGTTTTGATTACAGTGTAAGATGTAT
GTATTTTTAAAATTCAAAATAAAGCATTCATTTTGAAAAAAAAAAAAAAAAAAAA >gi|33869261|gb|BC005177.2| Homo sapiens transmembrane protein 51, mRNA (cDNA
clone MGC:990 IMAGE:3507275), complete cds
CAACCCGGTCCCTGAGAGGGCACTGCGCCCTCTCCACCACTGCGTTCCCTCGGCTAAGAATCCCCCGAAC
CCCAGCCCCGCGATCGCGGCGCCCACCGAGGAGGCCGCCCGGGTGGGGCGCGGGGGTCGCGAAGCCCGCA
GCCCCGGACCGCCCAGCCGAGACGGAGCCGGACCCGCCGCCTCCCGGGTGGATCTTTAACTCAAGACTAG
CATGAAGAGTTGCCTTCTGGCCTGCCCTGAGTCTCCTCAAATAACAACAGGCCCTTCCACCGCAGCTATC
CGCACGGGAGGCCTCGCGATTGCTCGGAACCATCCCACAGGAGTTCAGCTGATATTTTCTAGTGTGGGGC
GAGAGATTTTGTGGAGCGCATTTAAGGGGTTTTTGTTGTGACTGCTGCCTTGTATATATTTATTTTCTTT
CTTGGAACTGGGCCTCGCCCTCCTCCCACTGACATGATGGCCCAGTCCAAGGCCAATGGCTCGCACTATG
CGCTGACCGCCATCGGCCTGGGGATGCTGGTCCTTGGGGTGATCATGGCCATGTGGAACCTGGTACCCGG
CTTCAGCGCGGCCGAGAAGCCAACAGCTCAGGGCAGCAACAAGACCGAGGTGGGTGGCGGCATCCTCAAG
AGCAAGACCTTCTCTGTGGCCTACGTGCTGGTCGGGGCCGGGGTGATGCTGCTGCTGCTTTCTATCTGCC Figure 20 (Continued)

```
TGAGTATCAGGGATAAGAGGAAGCAGCGGCAGGGCGAGGACCTGGCCCATGTCCAGCACCCGACAGGCGC
TGGGCCTCACGCCCAGGAGGAAGACAGGAGGAAGAAGAGGAGGATGAGGAGGCTGCCTCAAGGTACTATG
TTCCCAGCTACGAGGAAGTGATGAACACAAACTACTCAGAAGCAAGGGGAGAGGAGCAGAACCCGAGGTT
GAGCATCTCTCTCCCGTCCTATGAGTCACTGACGGGGCTCGACGAGACCACCCCCACATCCACCAGGGCT
GACGTGGAGGCCAGCCCTGGGAACCCCCCTGACAGGCAGAACTCTAAGTTGGCCAAACGACTGAAACCGC
TGAAAGTTCGAAGGATTAAATCTGAAAAGCTTCACCTCAAAGACTTTAGGATCAACCTCCCAGACAAAAA
CGTCCCTCCTCCCTCGATAGAGCCTTTGACTCCTCCACCGCAGTATGATGAAGTCCAGGAGAAGGCCCCC
GACACCCGGCCGCCCGACTGAATGGCCCCACTTGAGCCACGCTCCCTCCTGTCTCTCACACCTTTCACCC
CCAAGACTCTAACAAAGCCACATGAGCCACAGTTGAGAAGCGGAGGGGCCAGCTGTGCATGGAGCCATTT
GGATGCGGCGGGCGGGGGGGATTCTCTGTATCAGGAGTGACTTTGTTGCCCCACACAGCCTCCTGCTG
CAGGTGCTTTGGAAAGAGATGCTGCCTTGGAGCTGGTGAATCTGTGGACCACATTCAAGGGTGTGGCACA
GGCATCTTCCCATCCTTTTCACTCCGAATCGCTGGCGACACATTCTCCTTTCCAGCTAGGAAAGGGTTCC
TCGCGGCTGGTTTAGATTGTGGTTGTTTGTTTTGCTTCTACTAAGACTGTTTTGTTTCAAAAAGGAAACA
AGTTTTGTGTTTGCTGTCTACGCTGGAGTCCTGAACTGTGGGTAGAAAACACGACCTGGCTTTGTAGAAA
GGACACAGGGCTGTTTTATGAACTAAGCGGTGAGGCTCAGGTGGCGGCTCTCACAGAGCCCCTGATGCTG
TTGTTCTTTGAGGGCTTAAGGCCTGATGAACGTAGGCACGTGATGCGTAATAGTCTTCAATGGTACACTT
AACTAGTCTCTTCTGTGTAACAGCAAAAAAAAAAAAAAAAAA

>gi|12652972|gb|BC000247.1| Homo sapiens THAP domain containing 4, mRNA (cDNA
clone IMAGE:3356125), complete cds
AGAAGAAGAGGGGGGCTGGAGGCCATGGCCGCACCCGGAGAAAAGATGCCAGCAAGGCCACAGGGGGTGT
GAGGGGACACTCGAGTGCCGCCACCAGCAGAGGAGCTGCAGGTTGGTCACCGTCCTCGAGTGGAAACCCG
ATGGCCAAGCCAGAGTCCCGCAGGTTGAAGCAAGCTGCTCTGCAAGGTGAAGCCACACCCAGGGCGGCCC
AGGAGGCCGCCAGCCAGGAGCAGGCCCAGCAAGCTCTGGAACGGACTCCAGGAGATGGACTGGCCACCAT
GGTGGCAGGCAGTCAGGGAAAAGCAGAAGCGTCTGCCACAGATGCTGGCGATGAGAGCGCCACTTCCTCC
ATCGAAGGGGGCGTGACAGATAAGAGTGGCATTTCTATGGATGACTTTACGCCCCAGGATCTGGGGCGT
GCAAATTTATCGGCTCACTTCATTCGTACAGTTTCTCCTCTAAGCACACCCGAGAAAGGCCATCTGTCCC
CCGAGAGCCCATTGACCGCAAGAGGCTGAAGAAAGATGTGGAACCAAGCTGCAGTGGGAGCAGCCTGGGA
CCCGACAAGGGCCTGGCCCAGAGCCCTCCCAGCTCATCACTTACCGCGACACCGCAGAAGCCTTCCCAGA
GCCCCTCTGCCCCTCCTGCCGACGTCACCCCAAAGCCAGCCACGGAAGCCGTGCAGAGCGAGCACAGCGA
CGCCAGCCCCATGTCCATCAACGAGGTCATCCTGTCGGCGTCAGGGGCCTGCAAGCTCATCGACTCACTG
CACTCCTACTGCTTCTCCTCCCGGCAGAACAAGAGCCAGGTGTGCTGCCTGCGGGAGCAGGTGGAGAAGA
AGAACGGCGAGCTGAAGAGCCTGCGGCAGAGGGTCAGCCGCTCCGACAGCCAGGTGCGGAAGCTACAGGA
GAAGCTGGATGAGCTGAGGAGAGTGAGCGTCCCCTATCCAAGTAGCCTGCTGTCGCCCAGCCGCGAGCCC
CCCAAGATGAACCCAGTGGTGGAGCCACTGTCCTGGATGCTGGGCACCTGGCTGTCGGACCCACCTGGAG
CCGGGACCTACCCCACACTGCAGCCCTTCCAGTACCTGGAGGAGGTTCACATCTCCCACGTGGGCCAGCC
CATGCTGAACTTCTCGTTCAACTCCTTCCACCCGGACACGCGCAAGCCGATGCACAGAGAGTGTGGCTTC
ATTCGCCTCAAGCCCGACACCAACAAGGTGGCCTTTGTCAGCGCCCAGAACACAGGCGTGGTGGAAGTGG
AGGAGGGCGAGGTGAACGGGCAGGAGCTGTGCATCGCATCCCACTCCATCGCCAGGATCTCCTTCGCCAA
GGAGCCCCACGTAGAGCAGATCACCCGGAAGTTCAGGCTGAATTCTGAAGGCAAACTTGAGCAGACGGTC
TCCATGGCAACCACGACACAGCCAATGACTCAGCATCTTCACGTCACCTACAAGAAGGTGACCCCGTAAA
CCTAGAGCTTCTGGAGCCCTCGGGAGGGCCTGGCTACTGTGCCTCAACGGTTCGGCTCCTCAACAGACAG
```

Figure 20 (Continued)

TCCCTGCGGCAGAAGTGGGTGTGGCCGTGAGCCTCTGCAGGCTCAAGAGTGTTGTCCAGATGTTTCTGTA
CTGGCATAGAAAAACCAAATAAAAGGCCTTTATTTTTAAACAAAAAAAAAAAAAAAAAAAAAAAAAAAA
AAAAA

>gi|34785038|gb|BC005350.2| Homo sapiens regenerating islet-derived 1 alpha, mRNA
(cDNA clone MGC:12447 IMAGE:3950349), complete cds
GAGATTGTTGATTTGCCTCTTAAGCAAGAGATTCATTGCAGCTCAGCATGGCTCAGACCAGCTCATACTT
CATGCTGATCTCCTGCCTGATGTTTCTGTCTCAGAGCCAAGGCCAAGAGGCCCAGACAGAGTTGCCCCAG
GCCCGGATCAGCTGCCCAGAAGGCACCAATGCCTATCGCTCCTACTGCTACTACTTTAATGAAGACCGTG
AGACCTGGGTTGATGCAGATCTCTATTGCCAGAACATGAATTCGGGCAACCTGGTGTCTGTGCTCACCCA
GGCCGAGGGTGCCTTTGTGGCCTCACTGATTAAGGAGAGTGGCACTGATGACTTCAATGTCTGGATTGGC
CTCCATGACCCCAAAAAGAACCGCCGCTGGCACTGGAGCAGTGGGTCCCTGGTCTCCTACAAGTCCTGGG
GCATTGGAGCCCCAAGCAGTGTTAATCCTGGCTACTGTGTGAGCCTGACCTCAAGCACAGGATTCCAGAA
ATGGAAGGATGTGCCTTGTGAAGACAAGTTCTCCTTTGTCTGCAAGTTCAAAAACTAGAGGCAGCTGGAA
AATACATGTCTAGAACTGATCCAGCAATTACAACGGAGTCAAAAATTAAACCGGACCATCTCTCCAACTC
AACTCAACCTGGACACTCTCTTCTCTGCTGAGTTTGCCTTGTTAATCTTCAATAGTTTTACCTACCCCAG
TCTTTGGAACCCTAAATAATAAAAATAAACATGTTTCCACGAAAAAAAAAAAAAAAAAAAAAAAAAAAA >gi|14198279|gb|BC008201.1| Homo sapiens receptor accessory protein 6, mRNA (cDNA
clone MGC:9381 IMAGE:3865853), complete cds
GGAGCATCGCGGCTCAGGCTGCGGGAAAGCGGTGCGCGTGCAGCGGGGTGGGTGCCCTGGTCCGCGGGCG
AGCTCGAGCAGCCAACCCCGGGCGCGTCGGGGCCATGGACGGCCTGAGGCAGCGCGTGGAGCACTTCCTG
GAGCAAAGGAACCTGGTCACCGAAGTGCTGGGGGCGCTGGAGGCCAAGACCGGGGTGGAGAAGCGGTATC
TGGCTGCAGGAGCCGTCACTCTGCTAAGCCTGTATCTGCTGTTCGGCTACGGAGCGTCTCTGCTGTGCAA
TCTCATCGGATTTGTGTACCCCGCATATGCCTCAATCAAAGCTATCGAGAGCCCAAGCAAGGACGACGAC
ACTGTGTGGCTCACCTACTGGGTGGTGTACGCCCTGTTTGGGCTGGCCGAGTTCTTCAGCGATCTACTCC
TGTCCTGGTTCCCTTTCTACTACGTGGGCAAGTGCGCCTTCCTGTTGTTCTGCATGGCTCCCAGGCCCTG
GAACGGGGCTCTCATGCTGTATCAGCGCGTCGTGCGTCCGCTGTTCCTAAGGCACCACGGGGCCGTAGAC
AGAATCATGAACGACCTCAGCGGGCGAGCCCTGGACGCGGCGGCCGGAATAACCAGGAACGTCAAGCCAA
GCCAGACCCCGCAGCCGAAGGACAAGTGAAGCAGCCCCCTGAGCCTCACAAGGACCTCCTGGCTGGTGAG
GAGGGGGCCGCGCCAGGCTCCCAGGCCTCCACAGAGTCTTCAGCGCATCCCCCAACAGCAGCCCCTGCCA
GTCCCTCGGGTCCAGGCAAGGCCCTGGGGGTCTCCTTAAATGCCACCTCGGGCAAGTCCCAGTCCCAGTC
CTCGGCCACCCCAGCTCTGGATCCCAGGGCCAGCTGCCCTCTGGCTCTGGCTGTGGCTCCCGCCTGTCC
GGCAGGGCCCAGGGCCAGCGTCGGGCACAGGGCAGCTCCCACTGGTCTCGGCAACACACCCAGCCGCCTG
GTACTTCCTCCAGCCCCTCCCAGTCAGCCCTCCCGTCCTCGGGGCCCCTGCAGCCACCCAACGTCACCTC
CAGCCCGGTCTCACCCATGGTCCAGTCTCCCAGCAGCAGCAACATCCCCACGCAGCCCCCCAGCAAGTCC
TCTGGCAAGCCGGAGGACGCAGCCCCAAGACCAGCGGACAGCGCCAGAAGGAATCGTCGAAACAGCCTG
CCAGCAGCGCCTCAGTGCCCGAGCTGGTCCCCTGCCATTCCGGGACCTCTCTGGAGTACACTTCGGAGTC
CACCACCGAGATCACCTGCAGCTGGCCACACCACAGGCCCCGTGCCTGCAGCACTACTGGTGCCTGAAA
CACCTGGCCTGCTAGGAGGCTCCAATAAAGCTAACCCGGACCAAAAAAAAAAAAAAAAAAAAAA

Figure 20 (Continued)

\>gi|17390461|gb|BC018206.1| Homo sapiens family with sequence similarity 128,
member A, mRNA (cDNA clone MGC:8772 IMAGE:3862861), complete cds
CTTTCGGCGGGCCTCGCGGATGGCGGCGCAGGGCGTAGGGCCTGGGCCGGGGTCGGCGGCGCCCCGGGG
CTGGAGGCGGCCCGGCAGAAGCTGGCGCTGCGGCGCAAGAAGGTGCTGAGCACCGAGGAGATGGAGCTGT
ACGAGCTGGCTCAGGCGGCGGGCGGCGGTATCGACCCCGACGTGTTCAAGATCCTGGTGGACCTGCTGAA
GCTGAACGTGGCCCCCCTCGCCGTCTTCCAGATGCTCAAGTCCATGTGTGCCGGGCAGAGGCTAGCGAGC
GAGCCCCAGGACCCTGCGGCCGTGTCTCTGCCCACGTCGAGCGTGCCCGAGACCCGAGGGAGAGACAAAG
GCAGCGCTGCCCTCGGGGGAGTATTGGCCCTGGCGGAACGCAGCAACCACGAGGGATCCAGCCAGAGGAT
GCCACGCCAGCCCAGCGCTACCAGGCTGCCCAAGGGGGCGGGCCTGGGAAGAGCCCTACGCAGGGCAGC
ACCTAGGATGGGGCAGAGACTTGTCACATCTTTGTCCCCAGCAAAGGCTACATGTTACCTCCTTCAGTTG
ATAATAAACCTTTCTGAGATGCAAAAAAAAAAAAAAAAAA \>gi|18203838|gb|BC021701.1| Homo sapiens chromosome 14 open reading frame 147,
mRNA (cDNA clone MGC:24406 IMAGE:4069530), complete cds
GGGAGACTGACGTGTGAACTGCATCGCGGGAGGCGCATGGCGGGATGGCGCTGGCGCGGGCCTGGAAGC
AGATGTCCTGGTTCTACTACCAGTACCTGCTGGTCACGGCGCTCTACATGCTGGAGCCCTGGGAGCGGAC
GGTGTTCAATTCCATGCTGGTTTCCATTGTGGGGATGGCACTATACACAGGATACGTCTTCGTGCCCCAG
CACATCATGGCGATATTGCACTACTTTGAAATCGTACAATGACCAAGATGCGACCAGGATCAGAGGTTCC
TTGGGGAAGACCCACCCTACGAAGTTGGAATGAGACCATCAGATGTGATAAGAAACTCTTCTAGATGTCA
ATATAACCAACCTTATAAAGACTAAAATTCATGAGTAGAACAGGAAAATCATCCTGACTCATGTGTTGTG
TTCTTTATTTTTAATTTTCAAAGAGGCTCTTGTATAGCAGTTTTTGTCTATTTTAACATTGTAGTCATTT
GTACTTTGATATCAGTATTTTCTTAACCTTTGTGACTGTTTCAATATTACCCCCGTGAAAGCTTTTCTTA
ATGTAACTTTGAGTACATTTTAATTGCCTTCTATTTTTAAAACTCAAAATCATTAGTTGGGCTTTACTGT
TCTTGCTATTGTATGGCATATACATCTGCCTGGATATATTTCTACTCTTGACCAAAGTTTTGTAAAGAAC
AATATAAGATTTCGGGTAGGGTATGGGAGGGAAGATATTTTATTGAGAACTACTTAACAAAAGATTTA
TCTGTAAGCTTGAACTCAGGAGTACAGTTTTAGCTATCTAGACTCTAACAGCTTTTGCTTTAAAATTATT
AAAGTGTTTCTTAATGAAAAGAAAAGATCTTGCTAAAGTTAAAATAAGGAACATTTCACCTTTTAAATA
TTTAATTCTTATGTGGACTTATTTCCAGAAAACTTTGGTGATAATTCTTGAGACAAAAGGTGGTTAAGTA
GCATTATTATGTAATGCTTATATACCATAGAGTTTTTAATAGAAGAGAAATCCATTTCCTCCGAGGGTCA
CTATTAACAATGTACTTCCTTAAATTTAGTTTAATGATTGTAATGGGTGCTGCATTTGCACATTGCATTA
AGTTATGATGAGACGAATTGTTGTTAAAAATTATAGCAAAAAGAAATGTAAACTTGGTTAAAATCCTTTC
ACTCTTTGTATTGTTTTTTTTAAGGTTTTTATTCCTTAAATGTAAAATGACTACCTAATTTTTTGATGTA
AATACATTAAATTCAAAGAGAAAAAAACCAAAAAAAAAAAAAAAAAAAAAAAAAAA \>gi|18490346|gb|BC022357.1| Homo sapiens chromosome 18 open reading frame 32,
mRNA (cDNA clone MGC:23866 IMAGE:4297017), complete cds
AGTGCGGACATTGTCAGCTGCGTTTCCGCGGTCGCGGTTGAGGAGCTCAAGCTTGGGAAAATGGTGTGCA
TTCCTTGTATCGTCATTCCAGTTCTGCTCTGGATCTACAAAAAATTCCTGGAGCCATATATATACCCTCT
GGTTTCCCCCTTCGTTAGTCGTATATGGCCTAAGAAAGCAATACAAGAATCCAATGATACAAACAAGGC
AAAGTAAACTTTAAGGGTGCAGACATGAATGGATTACCAACAAAAGGACCAACAGAAATCTGTGATAAAA
AGAAAGACTAAAGAAATTTTCCTAAAGGACCCCATCATTTAAAAAATGGACCTGATAATATGAAGCATCT
TCCTTGTAATTGTCTCTGACCTTTTTATCTGAGACCGGAATTCAGGATAGGAGTCTAGATATTTACCTGA Figure 20 (Continued)

```
TACTAATCAGGAAATATATGATATCCGTATTTAAAATGTAGTTAGTTATATTTAATGACCTCATTCCTAA
GTTCCTTTTTCGTTAATGTAGCTTTCATTTCTGTTATTGCTGTTTGAATAATATGATTAAATAGAAGGTT
TGTGCCAGTAGACATTATGTTACTAAATCAGCACTTTAAAATCTTTGGTTCTCTAATTCATATGAATTTG
CTGTTTGCTCTAATTTCTTTGGGCTCTTCTAATTTGAGTGGAGTACAATTTTGTTGTGAAACAGTCCAGT
GAAACTGTGCAGGGAAATGAAGGTAGAATTTTGGGAGGTAATAATGATGTGAAACATAAAGATTTAATAA
TTACTGTCCAACACAGTGGAGCAGCTTGTCCACAAATATAGTAATTACTATTTATTGCTCTAAGGAAGAT
TAAAAAAGATAGGGAAAAGGGGGAAACTTCTTTGAAAAATGAAACATCTGTTACATTAATGTCTAATTA
TAAAATTTTAATCCTTACTGCATTTCTTCTGTTCCTACAAATGTATTAAACATTCAGTTTAACTGGTAAA
AAAAAAAAAAAAAAAAAAAAAAAAAAAAAAAAAAAAAAAAAAAAAAAAAACCAAAAAAAAAAAAAAAAAA
AAAAA

>gi|19343599|gb|BC025787.1| Homo sapiens alkB, alkylation repair homolog 1 (E.
coli), mRNA (cDNA clone MGC:34444 IMAGE:5229152), complete cds
GGCCGCGAGATGGGGAAGATGGCAGCGGCCGTGGGCTCTGTGGCGACTCTGGCGACTGAGCCCGGGGAGG
ACGCCTTTCGGAAACTTTTCCGCTTCTACCGTCAGAGCCGGCCCGGGACCGCAGACCTGGAAGGGGTCAT
CGACTTCTCGGCGGCCCACGCAGCCCGTGGCAAGGGTCCTGGTGCCCAAAAGGTGATCAAATCTCAGCTA
AATGTGTCTTCTGTCAGTGAGCAGAATGCATATAGAGCAGGTCTTCAGCCCGTCAGCAAGTGGCAAGCCT
ATGGACTCAAAGGCTATCCTGGGTTTATTTTTATCCCAAACCCCTTCCTCCCAGGTTACCAGTGGCACTG
GGTGAAACAGTGCCTTAAGTTATATTCCCAGAAACCTAATGTATGTAACCTGGACAAACACATGTCTAAA
GAAGAGACCCAAGATCTGTGGGAACAGAGCAAAGAGTTCCTGAGGTATAAAGAAGCGACTAAACGGAGAC
CCCGAAGTTTACTGGAGAAACTGCGTTGGGTGACCGTAGGCTACCATTATAACTGGGACAGTAAGAAATA
CTCAGCAGATCATTACACACCTTTCCCTTCTGACCTGGGTTTCCTCTCAGAGCAAGTAGCCGCTGCCTGT
GGATTTGAGGATTTCCGAGCTGAAGCAGGGATCCTGAATTACTACCGCCTGGACTCCACACTGGGAATCC
ACGTAGACAGATCTGAGCTAGATCACTCCAAACCCTTGCTGTCATTCAGCTTTGGACAGTCCGCCATCTT
TCTCCTGGGTGGTCTTCAAAGGGATGAGGCCCCCACGGCCATGTTTATGCACAGTGGTGACATCATGATA
ATGTCGGGTTTCAGCCGCCTCTTGAACCACGCAGTCCCTCGTGTCCTTCCAAATCCAGAAGGGGAAGGCC
TGCCTCACTGCCTAGAGGCACCTCTCCCTGCTGTCCTCCCGAGAGATTCAATGGTAGAGCCTTGTTCTAT
GGAGGACTGGCAGGTGTGTGCCAGCTACTTGAAGACCGCTCGTGTTAACATGACTGTCCGACAGGTCCTG
GCCACAGACCAGAATTTCCCTCTAGAACCCATCGAGGATGAAAAAGAGACATCAGTACAGAAGGTTTCT
GCCATCTGGATGACCAGAATAGCGAAGTAAAACGGGCCAGGATAAACCCTCACAGCTGAGACTTGGAGAT
CCCATCCTTTTTACTCAGGCACCTGCTTACCGTAAATGATCATGTTATTGTGTATTGCCGTGGACTTCAG
CACCCAGACAAGCCAAAAACAGAGACAGGGAAGAACTCATTGTTGATCACACTGTTGCCTTGGAACCCAC
GCAGAAGTAAACTCATCCACTTTGCTCAGAGAAGTGTTTGACATGGTCTGTTCCTAGTTACATGTTGGCT
GTAATGTATGTTGAGAAGTCAGTCCAAGGAGGTATGTTCTTCCACAACAGCCTTCTCAGCCTCTGCTATT
TCCTTTGAGGAAGGTAGAAGTGAGTTTCCATGTTTGCAGAGTATTTAAATACCTCAGATTTTATTAATGA
GAAATACAGTACCCCTCCCTCCACTCCATCTGGTAATTTATGGTAAAATTGTGGTTCTGTGAACCAGCTA
TTAGTCTCATCTTCTTAACTCCCTCAGGCATCATCAAATTCTTTGATCTTCTCTTCCACCTCTCTGGCTC
TCATGGAAGAATCCTTTACACATGAAAACAATGGAACTGGAAAATCTTGTCTTTTAGAAAAGAAATTAAT
CACAACTATCTCTCTTGCCTAAAAGATAAATATAGGTAAACCCAAGGAAAGGGGAATTTAGTTTCTAC
ATGTCATTTCGGTCTCCAAACTCCCTGTTGGCTTTTTAATGCAATTTTAATTGTTGGAATAAAAAAGTCC
CAAGGGTGTTTTGTTACTGTTTTCTCCATGAATAAACTCACTTGATTTAAATTAAAATAAAAAAAAAAAA
AAAAAAAA
```

Figure 20 (Continued)

>gi|20809559|gb|BC029480.1| Homo sapiens alanyl-tRNA synthetase domain containing
1 pseudogene, mRNA (cDNA clone IMAGE:4734912)
AAATCAACACATTGAGTCAAGAAAAATGAAACACAGAAACACTCTAAATAAAAGAAGATAAGTCTTCAGA
AACCAACCCTAATGAAATGAAGATATGTGATTAACCTGACAGGAAATTAAAAAGAGCAACCATAAAGAGT
CTCATGGGAGCAATGCATGAACAAACTGAGAATTTTCATAAAGAAATAAAAGATAACAAAAAGTATAAAG
TTGAAGAATACAATAACTGGACTCAAAAATTTAATGTGTCCAACAGAAGAATCGATGAAGCAGAAGAAAG
GGCTATCAAACTTGTAGATAGGCCATTGGAAATCATGTAATGTGAGGAGAAAAAAGAAAAAAGATTGAAG
ATAGTTTAAGAGACTTTTGAGACATCCTCAAAGGGGAATAATTTATACATTACCAGATGGAGAAGATAGA
GGGAAAAGGACAGAAAACATATTTGAAGAAATAATGTCAGAAAACCTCATAATTCTGGCAAGGAAATAGA
AATTTAGATCTAAGAATCTCGAACATCAGGTATGATGAATCCAAGGAGACTCACACCAAACCATATTGTA
ATTAAATAAAGGTTAAAGACAATCTTCAGAGCAGCAAGGGAATAGTCTCTTCTTACATACAAAATGATCC
ACGGAAGACTGTCAGCAGACTTCACCAGAAAACTTTCACGCCAGAAGGCAGTCGTGATATATACAAAAAA
AAAAAAAAAAAAAGAAAAAAAAA >gi|34190053|gb|BC032825.2| Homo sapiens SH3-domain GRB2-like 2, mRNA (cDNA clone
MGC:26367 IMAGE:4820321), complete cds
GTCGAGTGTTTCTCAGCAAGAGCCCGTGTCCCGCTAGGCTCGGCGCCCTCGCGCCCATAGCCCCGGCGGC
GGCACGACCAGAGGCGGCCAGGGGAGCGCGCCGCCCCGCTCGGCCCTCCAGTCCCGCTCCGCCGCCTCCC
TCCCGCACAGCAGCCGCCAGCGCGGCCTCCTGCACCATGTCGGTGGCCGGCCTCAAGAAGCAGTTCCATA
AAGCCACTCAGAAAGTGAGTGAGAAGGTTGGAGGAGCTGAAGGAACCAAGCTAGATGATGACTTCAAAGA
GATGGAAAGGAAAGTGGATGTCACCAGCAGGGCTGTGATGGAAATAATGACTAAAACAATTGAATACCTT
CAACCCAATCCAGCTTCCAGAGCTAAGCTCAGCATGATCAACACCATGTCAAAAATCCGTGGCCAGGAGA
AGGGGCCAGGCTATCCTCAGGCAGAGGCGCTGCTGGCAGAGGCCATGCTCAAATTTGGAAGAGAGCTTGG
AGATGATTGCAACTTTGGCCCAGCACTTGGTGAGGTCGGGGAGGCCATGCGGGAACTGTCGGAGGTCAAA
GACTCTTTGGACATAGAAGTGAAGCAGAACTTCATTGACCCTCTTCAGAATCTTCATGACAAAGATCTTA
GGGAAATTCAACATCATCTAAAGAAGTTGGAGGGTCGACGCCTGGATTTTGATTATAAGAAGGAACGACA
AGGCAAGATTCCGGATGAAGAGCTTCGTCAAGCTCTAGAGAAATTTGATGAGTCTAAGGAAATTGCTGAG
TCAAGCATGTTCAATCTCTTGGAGATGGATATTGAACAAGTGAGCCAGCTCTCTGCACTTGTGCAAGCTC
AGCTGGAGTACCACAAGCAGGCAGTCCAGATCCTGCAGCAAGTCACGGTCAGACTGGAAGAAAGAATAAG
ACAGGCTTCATCTCAGCCTAGAAGGGAATATCAACCTAAACCACGAATGAGCCTGGAGTTTCCAACTGGA
GACAGTACTCAGCCCAATGGGGGTCTCTCCCACTAACCAAATTGATGAGAACTGGTATGAGGGGATGCTG
CATGGCCATTCAGGCTTCTTCCCCATCAATTATGTGGAAATTCTGGTTGCCCTGCCCCATTAGGATGTTA
TGCTGGCTGGCTCGCCTCCTCTTGACCCAGATAGTTACGGTTAACCACTGCTTTGGCAATGCTGCTTATA
ACACATCCCAAGTGCAGGCCGCAGTGGTCCACGTCATCCAGCCCACCAAGTGACTTTGGTTGACTTGTG
GGCTCCCACAGGAGTCATGGTGATGGATGATATCCTCTTAGCCTGGTGGGCATGGCATGTGCTTTTTAAA
ACATCATCTGAGACCAGCCAGTAGTCACAGAACTGCTGTTTACACAGTTCTCAGGAGGCTGTGGTTTCTT
AGAATATGACCATGAGCCATTTCACAGAAAAACCATCCACCGAAGATATTGTCTATCACCCCAGGGGCC
ATCTGAAGGTCTCTTTGCATTTCTCCATGCAAAGAGGAGAAAGCTTTTGCTTTCACACTGTCCCTTCCCA
AATATGTGAGTCATGGAATTGTCAAAGTAAGCCTTCCCTCACCAGCAAATTGTCTCCTGATCTGAATGAA
TTTGTCTCTTAATGCATCCATAGAAAAGTGTTAATTGTGGGTTCAAAGCATTCTCTGCAAATAGGCATCT
CAGCTCCTCACACTTATGGCTATTTCTGACGTATAGCCAGTTTTCTTCCCTCCTTGCTATTAAAGCCAGA

Figure 20 (Continued)

```
GCGGTAATTCCAAATTATTTTTCAGTAAGACAGTTAATCAGCATTATTGTGAGAGGGACTGAAAAGAAAT
TCTCCATTATGAGGAATTGGGAAGAAATCTGGTATCCAAGCTTAAATTTCTTGCTATACAGAAACTATGT
ATGTATTTAGGCTATTTCTGAAGGGCACAGGGAAGGGGAACAAATATCTTCACTTCAGTTTTATTTGTG
AATTACATGTTTCATGAATCCATTTGGCACAGAGACACAAGGAAGAAAACACTAGTAACCATCTTTCCAC
TAGTTCATAGACTGAGAAACAGTAAATACCTTTCCTTTCCACTTTTACCCTGTGTTCTTTGAACATCATT
TGTGCAGATTCTGCCCTCAATGAGGACCAAATAAAGATGATTTTTGTGCTTAGCAGTTTAAGGTATATGG
CTGCATATGCAAAACTCTTTCCCAATTCAGTCGCTACTTTTACTTCTGCCCTTTCTATCCATCGTCTTCA
TTTTGTGTGTACAGTGCTGTGTGTAAGCTTATCAGTGTGTTTTTTATTTGTATCAGTCATGAAAGTCCTG
TTAGGTATCCAGAGTTCTATTTATCTAGCTGTACAGACTCTTTCAGAGGTTTAACGTGCTGCTTCCGATG
TGCCACCTGCAGTAGTGGATCATGTGGAGTGAAAGGCAAATCTTACTGCTTAATGTATAAACTCTCACCA
CAGGAAGCATCGCTGTTTCCAATAAATATTGCTGAAGACAGAAAAAAAAAAAAAAAAA

>gi|21619964|gb|BC033167.1| Homo sapiens calcium binding protein 4, mRNA (cDNA
clone MGC:45795 IMAGE:4549347), complete cds
AGGCAGCTGTCCCCAGCGGCCAGTGTCCCCCATGCCGGATCTCTAGGATCTGGAAGGCCGCTGCTGCCAG
GAACAAGAAGTCAGAGAGGGCCAGGCTGAGCAGGAGCAGCGCCAGACGCGTGCCAGCTCCATGCCGGCC
TGGGAGCCGGCCAGCCACGCCATCAACCCATTGGCTGGCAGCCCAAGGAGCAGCAGGGCCACCAGGAAGA
CCGTGTCCCAGCCACCTTGGGGTCCCACCGACATCGTCCTGACTCCCTGCACGACGCTGCTCAGAGGACA
TACGGGCCCCTGCTCAATCGAGTCTTCGGGAAGGCCAACATGAGCAGGGGATGAAGGAGGAAGGATGACA
GAGCCGTGGCTGGCCCTGGGGACATCCTGGACTCTCCCCCTGCAGGACCGCGAACTGGGCCCCGAGGAGC
TAGACGAGCTTCAGGCCGCCTTCGAGGAGTTTGACACTGACCGTGACGGCTACATCAGCCACCGGGAGCT
GGGTGACTGCATGCGGACCCTGGGCTACATGCCCACCGAGATGGAGCTCCTGGAGGTCTCGCAGCACATC
AAGATGCGCATGGGCGGCCGTGTGGACTTTGAGGAGTTTGTAGAACTGATAGGCCCAAAGCTGAGGGAGG
AGACGGCGCACATGCTGGGGGTGCGAGAGCTGCGCATCGCCTTCCGAGAGTTTGACAGGGACAGGGATGG
ACGAATTACGGTGGCGGAGCTGCGGGAGGCGGTACCGGCTCTGCTCGGGGAGCCGCTGGCGGGTCCTGAG
CTGGACGAGATGCTCCGAGAAGTGGACCTCAATGGGGATGGCACCGTAGACTTTGACGAGTTTGTGATGA
TGCTCTCCCGCCACTGAGGCTCCAGGAGGGAATATCTGTTGCCCCTGCGGCCCCAGACACCAGCCAGACC
CAGGCTGCAGGCCTCCCCCAGGAGCCTCCAGGATGGAGATGGAGACCCAGCAGCCCCCAGACTACTTCTA
TCCCTGAAAACACCTGGCCTCAATGTTGGCTTGTTATGTTACCTGCCCACCCTCATCCTTACCTCCTCCT
ACTCAAGCTGCCTGGAGAAGACCTGCTCTCAGCTGCCCACCGTTCCTCAGTGTGAGCAAGATTTGGGTCT
CTCCAGACCTCTGGGAGGTAGGGAGTTCCCTGGCACTGGCAGCATTCAGTGGGGACCCCCCAGTGGCATG
ATGAATGGAGAGGATGGCTGGACCCCTTCCACTACTTATGTTTATAATTTTTTTTTTTTTAATGAACTT
GAGCCGGGTGCAGTGGCTCACACCTGTAAGCCCAGCTGTCAGGGGGCAGAAGCGGGAGGATAGCTTGAGC
CCAGGAGTGCAAGACCTGCCTGGGCAATATACTGAGACCCCATTCTCCACAAAAAGGAAAAATAAAGAC
AAAAAAACAAACAAAAAAAAAAAAAAAAAA >gi|23272560|gb|BC035636.1| Homo sapiens amyloid beta (A4) precursor protein-
binding, family B, member 1 interacting protein, mRNA (cDNA clone IMAGE:5216297),
complete cds
CGCTCCTGAGAGAAGGGCGCGCGCGGCACAGGGGCCTTCCTTGCACCTCGGAGCAAAGCAGCTCGGATAG
CGCCACACGTCTGCGCCCTGCGTGGGAAGGGCAGGGCTGACAGCACTTCCTCCCCGGGGCAGAGACCTGG
AGCCCGGGTGCGGCAGTCTGCACCGCGCGTCGCTTTCCCGGCCGGAGCCTCGCCGCCTTCCCGCGCCCCG
```

Figure 20 (Continued)

CAGCGCCCCGCAGAGCAGTCGAGATGGGTGAGTCAAGTGAAGACATAGACCAAATGTTCAGCACTTTGCT
GGGAGAGATGGATCTTCTGACTCAGAGTTTAGGAGTTGACACTCTCCCTCCTCCTGACCCTAATCCACCC
AGAGCTGAATTTAACTACAGTGTGGGGTTTAAAGATTTAAATGAGTCCTTAAATGCACTGGAAGACCAAG
ATTTAGATGCTCTCATGGCAGATCTGGTAGCAGACATAAGTGAGGCTGAGCAGAGGACAATCCAGGCACA
GAAAGAGTCCTTGCAGAATCAACATCATTCAGCATCTCTACAAGCATCAATTTTCAGTGGTGCAGCCTCT
CTTGGTTATGGAACAAATGTTGCTGCCACTGGTATCAGCAATATGAGGATGACTTACCACCTCCACCAG
CCGATCCTGTGTTAGACCTTCCACTGCCACCACCACCTCCTGAACCTCTCTCTCAGGTAAGTATGTGGGA
CCAGAGATGGCAGGACCATCAACCTCTGCTACCTATCACTGATGTTCCTTGAAGTGATCATTACATTCCT
AAGTTGGTACATCCAAAGATCTGAGATACTAAAAAACAAAGATACAGAGCACGCTCATTGCAAAGCTAGA
ACCCTCCGTAAGCAAGCCACATGGGTGTGTATCAAGAATGTATTAGGGCCATATTCAGGATTTACTGTAG
TTTGCTTAAAAAATATTTGTATGCAAAAACTATTTGATAAAACTCAATCTTTTGGGGGAAATGTTTTATT
AACATCATATTGAAATGTGGAACTGATTATATATTTCCATGTCCCTGTTCTTAGCTCAGTACATAGAGAA
TAGAAGGCATTCATTATACATTTTCTGAGTAGAGTGAAATTGAATTTTGTTGAACTTGGCAGCCCTGTTC
AGTAGGACAGGTACATCCAAGTATCACTTGTAATGTCATAGTTGGGGAGGGTGTTACAAAGCAGGCAGAT
GATGGGTGCTTGATATTGATAAATTTCTGAATATTGAAAAACAGACAACTGGAAAGTTTAAATGATCATT
ATTTGGGATGTTAACTCATAGTATGTCTCTCATAAAAGTAAAAAGAGCACTTTTAAGGATTTTCTTTTTA
GAGTAAGCCAAATATTTTAGAGGAGAGTCCAGTTCAATTTCCTGTGGCTTCTACAATGGTCACACTGTGT
CATGATGTTTGGTACTCACAAATAAGACCCTAGGGACCCCGAAAGGTCATACAATGCCTTTTGAATGAAC
AAATATTGAATATAAATCAAATATTAAATTATACTCTATCACAAAAAAAAAAAAAAAAAAAAAAAAAAAA
AAAAAAAAAAAAA

>gi|23273657|gb|BC036335.1| Homo sapiens BTB (POZ) domain containing 12, mRNA (cDNA clone IMAGE:4340346)
ACTAGTTCTAGATCGCGAGCGGCCGCACCTTGCTCTCCCTCGGGCTGCTGGTTGCTGACTTTGGCGCCAT
GGTCAATAACCCACACCTGAGTGATGTCCAGTTTCAGACGGACAGCGGGGAGGTGCTTTACGCCCACAAG
TTCGTGCTTTATGCCCGATGCCCGCTCCTCATCCAGTATGTGAACAATGAAGGCTTCTCCGCTGTAGAGG
ACGGGGTTCTGACCCAGCGTGTCCTGCTGGGTGACGTGAGCACCGAGGCCGCCCGCACGTTCCTGCACTA
TCTCTACACTGCGGACACTGGCCTTCCTCCTGGCCTTAGCTCTGAGCTGAGCTCCCTGGCCCACAGGTTT
GGCGTGAGTGAGCTCGTTCACCTGTGCGAACAGGTGCCTATTGCCACTGACTCAGAGGGCAAACCATGGG
AGGAGAAGGAAGCAGAGAATTGCGAAAGCAGGGCCGAGAATTTCCAGGAACTCTTGAGGTCAATGTGGGC
AGATGAAGAGGAGGAAGCGGAGACTTTGTTGAAATCCAAGGACCACGAAGAAGATCAAGAAAACGTGAAT
GAAGCAGAAATGGAAGAAATTTATGAATTTGCAGCTACTCAGCGAAAGCTTCTCCAGGAAGAAAGGGCAG
CGGGTGCCGGCGAGGACGCTGACTGGCTGGAGGGTGGCAGTCCGGTTTCTGGGCAACTCCTAGCAGGTGT
CCAGGTGCAGAAACAGTGGGACAAGGTGGAGGAGATGGAGCCGTTGGAGCCAGGAAGAGATGAGGCCGCC
ACCACCTGGGAGAAGATGGACAGTGCGCTCTCCCGCCACCCCAGGGCCAGCACTCAGGGGCACGGGGAG
CAGAGGCCCCTGAGCAGGAGGCGCCAGAGGAGGCGCTTGGCCATTCCAGCTGCTCCAGCCCTTCCAGGGA
CTGCCAGGCAGAGAGAAAAGAAGGCTCTCTTCCGCACTCAGATGATGCCGGGGATTACGAACAGCTCTTC
TCATCAACTCAGGGAGAGATCTCAGAGCCGTCCCAAATAACAAGTGAGCCCGAGGAACAAAGTGGCGCTG
TCAGGGAAAGGGGGCTGGAGGTTTCTCATCGCCTGGCTCCCTGGCAGGCATCTCCACCGCACCCGTGCCG
CTTCCTATTGGGGCCTCCCCAGGGCGGGAGTCCCCGCGGGTCTCATCACACAAGTGGGTCGTCCCTGTCA
ACACCCCGGTCCCGTGGCGGAACTTCCCAGGTGGGCTCCCCAACCTTGCTGTCTCCAGCTGTGCCATCAA
AGCAGAAAAGGGACAGGAGCATCCTCACGCTGTCTAAAGAGCCAGGGCACCAGAAAGGCAAAGAGCGTCG

Figure 20 (Continued)

```
GTCCGTGCTGGAGTGCAGAAATAAGGGGGTCCTGATGTTCCCAGAAAAATCTCTGTCTATTGACCTAACC
CAGTCAAATCCTGACCATTCGAGCTCCAGATCTCAGAAATCTTCATCCAAACTGAACGAAGAAGATGAGG
TCATCCTCTTACTGGACTCGGATGAGGAGCTGGAGCTAGAACAAACCAAAATGAAGTCCATTTCTAGTGA
TCCTCTGGAAGAAAAGAAAGCTCTAGAAATTAGCCCTAGGTCCTGTGAGCTGTTTTCCATCATTGATGTT
GATGCAGATCAGGAACCTTCCCAGAGCCCACCAAGAAGCGAAGCTGTGCTGCAGCAGGAGGATGAGGGGG
CGCTGCCGGAGAATCGGGGCTCTTTGGGCAGGAGAGGGCTCCCTGGCTGTTCTGTGACCGTGAGAGCAG
CCCCAGCGAGGCCAGCACCACAGACACCTCGTGGCTGGTGCCCGCCACCCCGCTGGCCAGCAGAAGCCGT
GACTGTTCTTCCCAGACCCAAATCAGCAGCCTCAGGAGCGGGCTGGCCGTGCAGGCGGTGACTCAGCACA
CGCCCAGGGCCTCAGTAGGAAACAGGGAAGGGAACGAAGTCGCACAGAAGTTTTCTGTCATCAGGCCCCA
GACACCACCGCCCAGACACCGTCCTCATGCCTCACTCCCGTCTCTCCAGGAACTTCTGACGGCAGAAGG
CAAGGCCACAGAAGCCCTTCCCGTCCCCACCCGGGGGCCACCCGCACTCCTCTCCGCTGGCTCCACATC
CCATCTCAGGGGACCGCGCCCACTTCAGCAGGCGGTTCCTGAAACACTCGCCGCCTGGGCCAAGCTTCCT
GAACCAGACCCCAGCGGGTGAAGTGGTGGAAGTCGGAGACAGTGACGATGAGCAGGAGGTGGCCTCCCAT
CAGGCCAACAGAAGCCCCCCACTGGACAGTGACCCCCAATTCCAATTGACGACTGCTGCTGGCACATGG
AGCCCCTCTCGCCAATTCCCATTGACCACTGGAACCTGGAGCGGACCGGCCCCCTGAGCACCAGCAGCCC
CAGCCGCAGGATGAACGAGGCCGCCGACAGCCGTGACTGTCGCTCCCGGGACTCCTGGACACCACCCCC
ATCCGAGGAAGCTGCACTACCCAGAGGAAATTGCAAGAGAAGTCCTCGGGCGCGGGCTCCTGGGGAACA
GCAGGCCGAGCTTTCTGAATTCGGCTCTGTGGGACGTTTGGGACGGGGAAGAGCAGAGGCCTCCAGAGAC
CCCTCCTCCGGCCCAGATGCCAAGCGCTGGTGGAGCTCAGAAGCCCGAAGGGTTAGAGACACCCAAAGGT
GCTAATCGGAAGAAGAACTTGCCCCCCAAAGTGCCCATAACGCCGATGCCACAGTATTCCATTATGGAGA
CGCCGGTGCTGAAGAAGGAACTGGATAGGTTTGGAGTCCGCCCTCTGCCTAAACGCCAGATGGTTCTGAA
GCTGAAGGAGATATTCCAGTACACTCACCAGACCCTGGACTCAGACTCCGAGGACGAGAGCCAGTCCTCA
CAGCCGCTGTTGCAGGCGCCTCACTGCCAGACCCTCGCCTCCCAGACCTACAAGCCTTCAAGGGCAGGGG
TCCATGCCCAGCAGGAGGCCACCACAGGACCTGGGGCCCATAGGCCCAAGGGACCTGCTAAGACCAAGGG
CCCCCGACATCAAAGGAAGCATCATGAAAGCATCACACCCCCAAGCAGGTCGCCCACCAAGGAGGCACCT
CCAGGCCTCAATGATGACGCCCAGATCCCAGCCTCTCAAGAATCCGTGGCCACCTCTGTGGATGGCAGTG
ACAGCTCCTTGAGCTCACAGAGTTCTTCCTCCTGTGAGTTTGGAGCGGCATTTGAGTCTGCAGGTGAAGA
GGAGGGCGAGGGGAGGTCAGTGCCTCGCAGGCAGCCGTGCAGGCGGCGGACACAGACGAGGCGCTGAGG
TGCTACATCCGCTCCAAGCCGGCCCTGTACCAGAAGGTGCTGCTGTACCAGCCCTTTGAGCTGCGGGAGC
TGCAGGCAGAGCTGAGGCAGAACGGCCTCCGTGTGTCCTCGCGCAGGCTGTTGGACTTCCTGGACACCCA
CTGTATCACCTTCACCACTGCCGCCACCCGCAGGGAGAAGCTCCAGGGCAGGAGGCGGCAGCCTCGGGGC
AAGAAGAAGGTGGAGCGGAACTGATGGGGCCATCCCGACCCCACCCCAACCTGCCATCAGCAGCCCCAC
CCCCGCCATTTGCAGGGAGGACCTGGGACACCCAGCGTGGGTCAGGCCTCCACAGGCATTTCTGGGCCTG
GGGACCACATCAGCTCTGCGCTGTGATGATGACCACAGCCCAATCCAGGGCTTCCTCCTCTGGGCTCTGC
TTTCTAGGGTGGCATTTGGAGCATGTCACCCACTGGATTTACAGACTCCAGCCCCTTCCTCTGTCCGTGC
TCACAGTGTGTCTCCCTTTTTGGTTTTCTTTTTTTTTTCTTTTTGAGACAGTCGTGCTGTGTCACCTAG
GCTGGAGTGCAGTGGCACAATCTCGGCTCACTGCAACCTCCGCCTCCCGGGTTCAAGCAATTCTCCTGCC
TCAGCCTCCCAGATAGCTGGGACTACAGGCACACGCTGCCACGCCCAGCTGATTTTTTATATTTTAGTAG
AAACGGGGTTTCACCATGTTGCTCAGGCTGGTCACAAACTCCAGAGCTCAGGCAATCCGCCTGCTGCGGC
CTCCCAAAGTGCTGGGATCACAGGCGCCAGCCACTGCGCCCGGCCCAGTGTGTCTCCCTTAACCCAAGAG
GGCCCTCAGCTGTCCCAGGGGGCAGTGGGCCATCACCAGCTGGCCAGGGCATGGCCTATTCTGCCACATT
TGCCACCCTCTGAGCCCACCAGTCCTGGGCACAGCTGCCCTACATGTCTGTCCTGAGATGGACGTCAGGT
```

Figure 20 (Continued)

CCAGCCTGCCCCGGCAGCCCGGGCCCGTCCTCCTCAGCACTCAGGCCAACCCCAGCCACCGCCAGCCTGA
GACCAGGTGTCCTGAGGCTCCCTGCACTGCCACAGCCCAGATGCAGTTCTCCTGACCCAGCCGTGCTACC
CGGACACTTGTCATTGTTACCAGCAGTCTCCAAACTGGACAGTGCACAAGGGCCCAGAACAACTCTGATG
CCACCACAAAACAAACATGTTCACTAGCGGATTCCATTCTTTGGGTTAAAGCTGCCTCCAGCCTCAGGAG
CAGTGTGGAGGAAGATGAGGGCCAGGAAAGAAGGAAACCTTGGTTTCTCCATCCTTGTGAATGTCCTCGT
CTGTTTCAAATACAGTGCAGTCAGTTTTATATGATGTGCAATAAACCAAAAAGGCTTTATTAAAAAAAAA
AAAAAA

>gi|28277116|gb|BC045655.1| Homo sapiens transmembrane protein 97, mRNA (cDNA
clone IMAGE:5269880), complete cds
TGGGGTTCCAGTTGCCTCTCTCGGGTCCTGCCCATGCCTCCCCGCTCCTAACCCAACTTTAGTTCGGTG
TTTTCCTCGGGCTTTGTCTCTATCCCAGCCCCTTCTCCCAAGCGGCGGGGGCGAACGCTTTGTTTCCTTT
AAAGTCACTTCTTCCCTGGGTTTAAGGTTTCCCGCGATTCCACCTCTGGCCGGTTGTCAGTGTCTGAGGG
AAGTAGTCTGGATGAAGTGGTGTCCAAAGTCACATGTCAGCATGGATCCGCATCCTTTTTATTTGACAAG
TTTAGAAACCTGCTGAAGTGGTATGCTAAGGAGTTCAAAGACCCACTGCTACAGGAGCCCCCAGCCTGGT
TTAAGTCCTTTCTGTTTTGCGAGCTTGTGTTTCAGCTGCCTTTCTTTCCCATTGCAACGTATGCCTTCCT
CAAAGGAAGCTGCAAGTGGATTCGAACTCCTGCAATCATCTACTCTGTTCACACCATGACAACCTTAATT
CCGATACTCTCCACATTTCTGTTTGAGGATTTCTCCAAAGCCAGTGGTTTCAAGGGACAAAGACCTGAGA
CTTTGCATGAACGGTTAACCCTTGTGTCTGTCTATGCCCCCTACTTACTCATCCCATTCATACTTTTAAT
TTTCATGTTGCGGAGCCCCTACTACAAGTATGAAGAGAAAAGAAAAAAAAAATGAAGGAAACAACCACTG
GCCCAGGGTAGAGATGCCTACAGGGTGGTTGCTTGTTGGATACAATACAAGGAACACTGCTCAGAACCCA
CGTCTTCAGCAGCATTTGAAACACTGGCAGCAATGCACAAGAGCAAGATGGTGTCAGGAACCATGTCAAA
CCCTCACCTTCTTCCATTTTTTTTTTTTTTTAAGACAGTCTCACTCTGTTGCCCAGGCTGGAGTAAAG
GGCAGTGGCATGATCTCGGCTCACTGCAACCTCCGCCTCCTGGGCTCAAGCCATCTTCCTTAGCCTCCCA
AGTAGCTAGAACTACAGGTGTGTACCAACACGTATGGCTAATTTGTTTTGTTTTTTTTGTGTGTGTGGAG
ACAGGGTTTTGCCATGTTGCCCAGGTTGGTCTCGAACGCCTAGGCTCAAGTGATCTGCCCACCTCAGTCT
CCCTAAGTGCTGGGATTACAGACGTGAACCACTGGGCCCAGCCCAAACCTTCACCTTCTAAGGGCACTGG
GATGAACGGACCGATCGGCTTGAGGGTGGGCAAAGGGGTGTGGGCTAGGTTATAAGGAAGTGGTACCAAA
TAACTGTGTGCCTGAGTTCCACCGCAAGATTACTAAAAGCAGGACCAGACCAGAAACTGCTAAAGAACAT
GGCCTGTTTGACATGTTCATGAGTCACCTGACCCACAGCATATATGCTTGTGACTAAACCCTCCACTCCT
GATTCTCAAGAGTGTATCACCTGTCAGCAAAATGAATAGTGGGATATTTTGGGCCATTTTAAATGTGAAA
TTTTGCCTCTTTAATGTTAATTCAAAACTATATCAATGTTTTCTTGTTCCCACCTCTAACCCAAGGAAAA
AAGAGAAAACATACTATGCAAAGGAAGTTTAAACTTAAGTTTTCCTTAAGGGTCAGCCCAACAATGACTT
TCAGTCAAATGGATTAAACTGGAAAATGTTTTTGTTTCTGTTGTAAACAGATCATCCTAGGCGAAAGTTT
TTTTTGTTTGTTTGCTTTTAAATTAGTTTATTTCTAAATCTTAGTCTTCCACATTTCTAGAGGCCACCTG
ACACAAGTCCCTGTATCTGAAGTCTAGCATCTCAAGGCTGATCTGGAAGTGTGCTAGTATGCTCCCTAGT
GGATAACTTAATCTTTTAATACAGTTCCGTCATTCCCATCTTGTTTTCAGAAGAGAAGGTGGCTACAGCC
AGGCATAACATATCCACTGTGTGCATAGAGGGTCTCTTCACGTTGATGCTTGGCATTCCATCAGCTTTCT
CTAAGTCTTTGCTCAAGTTCAACCTTAAAATGATGTTAGACAACAGGTCCCAGTCAGTTCCCTCTATTTT
CACCCATTTTGCTCACAAGCCATATTGGCCCGATTAGTGGTACTGTCTGACTCACGTGTGTGATCCAAAT
AAAGGTAGCTGCTGACCAAAAAAAAAAAAAAAAA

Figure 20 (Continued)

>gi|31127245|gb|BC052805.1| Homo sapiens erythrocyte membrane protein band 4.9
(dematin), mRNA (cDNA clone MGC:59859 IMAGE:6269658), complete cds
GTGACCTTGTGGGGAAAGGAGCCAAGAACGGGGCGTCGGGGGGCCTGGGACCCCCCTGCCTGAGAGATAC
AGGAATCCTGGCCCCGTGTTGTGGACACAAGCGCCCATCCTCAAGGTCCTGAGAACTCCTGAACTTCCAA
AGCCTGGAGAGTCACCGCCGAGGGATGAGGACGCGCCAGCCCGGGGAACGCGCCAGCTGCTTTCGCGGC
CCCAAGCGCGCAGTGCCCAGCAGCCGCGCCGAGCCTGACACGCTGTCCTCTCCCTCGCGCACAGGGCTC
TGCGAGTGACCCGGCGGGCGAGCTCCGTGCTGCATGGAACGGCTGCAGAAGCAACCACTTACCTCCCCG
GGAGCGTGAGCCCTCCCGAGATTCCAGTGTGCCTGGCTCTCCCTCCAGCATCGTGGCCAAGATGGACAA
TCAGGTGCTGGGCTACAAGGACCTGGCTGCCATCCCCAAGGACAAGGCCATCCTGGACATCGAGCGGCCC
GACCTCATGATCTACGAGCCTCACTTTACTTATTCCCTCCTGGAACACGTGGAGCTGCCTCGCAGCCGCG
AGCGCTCGCTGTCACCCAAATCCACATCCCCCCACCATCCCCAGAGGTGTGGGCGGACAGCCGGTCGCC
TGGAATCATCTCTCAGGCCTCGGCCCCAGAACCACTGGAACCCCCGGACCAGCCTGCCCCATTTCCAC
CACCCTGAGACCTCCCGCCCAGATTCCAACATCTACAAGAAGCCTCCCATCTATAAGCAGAGAGAGTCCG
TGGGAGGCAGCCCTCAGACCAAGCACCTCATCGAGGATCTCATCATCGAGTCATCCAAGTTTCCTGCAGC
CCAGCCCCAGACCCCAACCAGCCAGCCAAAATCGAAACCGACTACTGGCCATGCCCCCCGTCTCTGGCT
GTTGTGGAGACAGAATGGAGGAAGCGGAAGGCGTCTCGGAGGGGAGCAGAGGAAGAGGAGGAGGAGGAAG
ATGACGACTCTGGAGAGGAGATGAAGGCTCTCAGGGAGCGTCAGAGAGAGGAACTCAGTAAGGTTACTTC
CAACTTGGGAAAGATGATCTTGAAAGAAGAGATGGAAAAGTCATTGCCGATCCGAAGGAAAACCCGCTCT
CTGCCTGACCGGACACCCTTCCATACCTCCTTGCACCAGGGAACGTCTAAATCTTCCTCTCTCCCCGCCT
ATGGCAGGACCACCCTGAGCCGGCTACAGTCCACAGAGTTCAGCCCATCAGGGAGTGAGACTGGAAGCCC
AGGCCTGCAGATCTATCCCTATGAAATGCTAGTGGTGACCAACAAGGGGCGAACCAAGCTGCCACCGGGG
GTGGATCGGATGCGGCTTGAGAGGCATCTGTCTGCCGAGGACTTCTCAAGGGTATTTGCCATGTCCCCTG
AAGAGTTTGGCAAGCTGGCTCTGTGGAAGCGGAATGAGCTCAAGAAGAAGGCCTCTCTCTTCTGATGGCC
CCCACCTGCTCCGGGACGGCCCCCTTACCCCTGCTGCTTCAGGGTTTTTCCCCGGCGGGTTGGGAGGGGC
AGGAGGTGGGGTGGAAATAGGGTGGGCTCCTTTCCTCAGGTAGAGTGGGGGGCCAAAACCTCTGCAGTCC
CCGGCAGTGAGCTATGGACTTTCTTCCCCCTCACAAGGCTGGGGGCCTCCTGCTCTCGTCCCTGGCCCTC
CCTGCACAGGGCAAAGCCAGTCTGGGCTCTGGCACACAGAGTTCATGTTTGCGCCCTCTCCCTGCCCCTC
ACCCCAGAGGGTGAGGAGGAATGAGGGGCATTGGTGGTTAGGCCGGTTGGCTGTCTTGAACAGCTGGAGG
GAAGATGCAGGGGTGGGAAGCGGCCAGGCAGAAAGAGCTCCAGGCTCTTGTGTCGCCCACCCAGCCCTCC
CATACTCACTCCTGACAGCTTTCCTGCACTGCAGCTTCCTGCTCCTCTGACTCTAGTGGGAACAGGCCCC
AGCTCAGCCTCCGGCAGGGAGGTCACCCCTCCACTTCAGCTTGCCCTGACCTCCGCTCGCAAACCCCGAG
CTTCCAAGCCTTTTGCTCCAGCCCTGCGGCTTCCCCAGAAGCCTGGGCTTAGGGTGGAGATGCCGCCTAC
ACACGATCCTGGCCCTCCACCTGCCTCCAGGCCACGAAATGGGAATTCCAGCACTAAGCCAGGCACCGGG
CAGAAGCTGGGCCTTCCGCCTCCCTTGGATGGGGTCAAGAGGCCAGGCCTGGCACATTTTGGAGTGTCCT
GGCTACCAGCTCTCACCTACACCCACGCACCCCCCACACACTATGCTCTCTCAAGAATGTAATTTATTG
GGGCCCCCCAGCTGCTTTCCTCACCTGCCCCTGCCCTACCTTACACCCCAGCTTGACTTCTTTCCAGT
CCACGTGTGTATATAATGATATCTATATTTTTGCCCAGGTCTGGGTATTGCTCCTGCCCAGACCCTGACA
TCCCTTTCCACTGTGTGTGTGACCATGCTGGGGGAGGGGACTCTGCTTGGAATTAAAAGGTTGCATTGG
GTCCCTAAAAAAAAAAAAAAAAAAAAAAAAAAAAAAAAAAAAAAAAAAAAAAAA >gi|41223358|gb|BC065370.1| Homo sapiens chromosome 20 open reading frame 112,
mRNA (cDNA clone MGC:71176 IMAGE:6261963), complete cds

Figure 20 (Continued)

CTTCTGTGAGCAGCGAGGATTTTGATATGAGCGACTCCACATGGATGTCAGCTGACCCGCACCTGGCCTC
CAGCCTGAGCCCCAGCCAGGACGAGAGGATGCGGAGCCCGCAGAACCTCCACAGTCAAGAGGACGATGAC
TCCTCCTCTGAGAGTGGCAGCGGCAATGGCTCCTCCACCCTGAACCCATCCACGTCGAGCAGCACGCAGG
GCGACCCTGCCTTCCCCGAGATGAATGGCAACGGCGCCGTGGCCCCCATGGACTTCACCACGGCCGCCGA
GGATCAGCCCATCAACCTGTGTGACAAGCTCCCGCCGGCCACGGCACTTGGCACAGCCTCCTACCCCTCG
GATGGCTGCGGTGCCGACGGGCTGCGGAGCCGCGTCAAATACGGGGTGAAGACCACCCCCGAGTCCCCCC
CCTACAGCTCTGGGAGCTACGATTCCATCAAGACCGAGGTCAGCGGCTGCCCTGAGGACCTGACAGTGGG
CCGGGCCCCGACGGCAGATGATGACGACGATGACCACGATGACCATGAGGACAATGACAAGATGAACGAC
TCTGAAGGCATGGACCCTGAGCGTCTTAAGGCCTTCAACATGTTTGTGCGTCTCTTTGTGGACGAGAACC
TGGACCGCATGGTGCCCATCTCCAAGCAGCCCAAGGAGAAGATCCAGGCCATCATCGAGTCCTGCAGCCG
GCAGTTCCCTGAGTTCCAGGAGCGGGCCCGCAAGCGCATCCGCACGTACCTCAAGTCCTGCCGTCGCATG
AAGAAGAACGGCATGGAGATGACCAGACCCACGCCACCCCATCTGACCTCGGCCATGGCAGAAAACATCC
TGGCAGCTGCCTGTGAGAGCGAGACAAGAAAGGCAGCCAAGCGGATGCGTCTAGAGATCTACCAGTCCTC
ACAGGATGAGCCCATAGCCCTGGACAAGCAGCACTCGCGGGACTCCGCAGCCATCACCCACTCCACCTAC
TCACTGCCAGCCTCCTCCTACTCCCAGGACCCTGTGTACGCCAACGGCGGCCTCAACTACAGTTACCGCG
GGTACGGGGCCTTGAGCAGCAACCTGCAGCCCCCTGCCTCCCTCCAAACAGGAAACCACAGTAATGGGCC
CACGGACCTCAGCATGAAAGGCGGGGCCTCTACCACCTCCACCACCCCCAGCGCCTTGTCGGGGGAGCCC
CCAACAAGGCGCTGGGCTGCAGCTCTGTTTAGAATCACCTTCGTGGACCCTGATGTTAGAATCCCACCC
CCAGATAATTACCTTTCAAGTCTTAGGTGAGCAGAATTGCATATTTATTGAGAAAAGCAAAGTGGACCCT
TTCTTCCTCTCCCCTTAGTAATTTATTTTTCTGAAAATGGAAAAAAAAAAAAAAAAAAAAAAAAAAAAAA
AAAAAA

>gi|41351152|gb|BC065522.1| Homo sapiens vascular endothelial growth factor A,
mRNA (cDNA clone IMAGE:6006890), partial cds
GCGGCGGCGAGCCGCGGGCAGGGGCCGGAGCCCGCGCCCGGAGGCGGGGTGGAGGGGGTCGGGGCTCGCG
GCGTCGCACTGAAACTTTTCGTCCAACTTCTGGGCTGTTCTCGCTTCGGAGGAGCCGTGGTCCGCGCGGG
GGAAGCCGAGCCGAGCGGAGCCGCGAGAAGTGCTAGCTCGGGCCGGGAGGAGCCGCAGCCGGAGGAGGGG
GAGGAGGAAGAAGAGAAGGAAGAGGAGAGGGGGCCGCAGTGGCGACTCGGCGCTCGGAAGCCGGGCTCAT
GGACGGGTGAGGCGGCGGTGTGCGCAGACAGTGCTCCAGCCGCGCGCGCTCCCCAGGCCCTGGCCCGGGC
CTCGGGCCGGGGAGGAAGAGTAGCTCGCCGAGGCGCCGAGGAGAGCGGGCCGCCCCACAGCCCGAGCCGG
AGAGGGAGCGCGAGCCGCGCCGGCCCCGGTCGGGCCTCCGAAACCATGAACTTTCTGCTGTCTTGGGTGC
ATTGGAGCCTTGCCTTGCTGCTCTACCTCCACCATGCCAAGTGGTCCCAGGCTGCACCCATGGCAGAAGG
AGGAGGGCAGAATCATCACGAAGTGGTGAAGTTCATGGATGTCTATCAGCGCAGCTACTGCCATCCAATC
GAGACCCTGGTGGACATCTTCCAGGAGTACCCTGATGAGATCGAGTACATCTTCAAGCCATCCTGTGTGC
CCCTGATGCGATGCGGGGGCTGCTGCAATGACGAGGGCCTGGAGTGTGTGCCCACTGAGGAGTCCAACAT
CACCATGCAGATTATGCGGATCAAACCTCACCAAGGCCAGCACATAGGAGAGATGAGCTTCCTACAGCAC
AACAAATGTGAATGCAGACCAAAGAAAGATAGAGCAAGACAAGAAAAATGTGACAAGCCGAGGCGGTGAG
CCGGGCAGGAGGAAGGAGCCTCCCTCAGGGTTTCGGGAACCAGATCTCTCACCAGGAAAGACTGATACAG
AACGATCGATACAGAAACCACGCTGCCGCCACCACACCATCACCATCGACAGAACAGTCCTTAATCCAGA
AACCTGAAATGAAGGAAGAGGAGACTCTGCGCAGAGCACTTTGGGTCCGGAGGGCGAGACTCCGGCGGAA
GCATTCCCGGGCGGGTGACCCAGCACGGTCCCTCTTGGAATTGGATTCGCCATTTTATTTTTCTTGCTGC
TAAATCACCGAGCCCGGAAGATTAGAGAGTTTTATTTCTGGGATTCCTGTAGACACACCCACCCACATAC

Figure 20 (Continued)

ATACATTTATATATATATATTATATATATATAAAAATAAATATCTCTATTTTATATATATAAAATATA
TATATTCTTTTTTTAAATTAACAGTGCTAATGTTATTGGTGTCTTCACTGGATGTATTTGACTGCTGTGG
ACTTGAGTTGGGAGGGGAATGTTCCCACTCAGATCCTGACAGGGAAGAGGAGGAGATGAGAGACTCTGGC
ATGATCTTTTTTTTGTCCCACTTGGTGGGGCCAGGGTCCTCTCCCCTGCCCAGGAATGTGCAAGGCCAGG
GCATGGGGGCAAATATGACCCAGTTTTGGGAACACCGACAAACCCAGCCCTGGCGCTGAGCCTCTCTACC
CCAGGTCAGACGGACAGAAAGACAGATCACAGGTACAGGGATGAGGACACCGGCTCTGACCAGGAGTTTG
GGGAGCTTCAGGACATTGCTGTGCTTTGGGGATTCCCTCCACATGCTGCACGCGCATCTCGCCCCCAGGG
GCACTGCCTGGAAGATTCAGGAGCCTGGGCGGCCTTCGCTTACTCTCACCTGCTTCTGAGTTGCCCAGGA
GGCCACTGGCAGATGTCCCGGCGAAGAGAAGAGACACATTGTTGGAAGAAGCAGCCCATGACAGCTCCCC
TTCCTGGGACTCGCCCTCATCCTCTTCCTGCTCCCCTTCCTGGGGTGCAGCCTAAAAGGACCTATGTCCT
CACACCATTGAAACCACTAGTTCTGTCCCCCAGGAGACCTGGTTGTGTGTGTGAGTGGTTGACCTTC
CTCCATCCCCTGGTCCTTCCCTTCCCTTCCCGAGGCACAGAGAGACAGGGCAGGATCCACGTGCCCATTG
TGGAGGCAGAGAAAAGAGAAAGTGTTTTATATACGGTACTTATTTAATATCCCTTTTTAATTAGAAATTA
AAACAGTTAATTTAATTAAAGAGTAGGGTTTTTTTTCAGTATTCTTGGTTAATATTTAATTTCAACTATT
TATGAGATGTATCTTTTGCTCTCTCTTGCTCTCTTATTTGTACCGGTTTTTGTATATAAAATTCATGTTT
CCAATCTCTCTCTCCCTGATCGGTGACAGTCACTAGCTTATCTTGAACAGATATTTAATTTTGCTAACAC
TCAGCTCTGCCCTCCCCGATCCCCTGGCTCCCCAGCACACATTCCTTTGAAATAAGGTTTCAATATACAT
CTACATACTATATATATATTTGGCAACTTGTATTTGTGTGTATATATATATATATGTTTATGTATATA
TGTGATTCTGATAAAATAGACATTGCTATTCTGTTTTTTATATGTAAAAACAAAACAAGAAAAAATAGAG
AATTCTACATACTAAATCTCTCTCCTTTTTTAATTTTAATATTTGTTATCATTTATTTATTGGTGCTACT
GTTTATCCGTAATAATTGTGGGGAAAAGATATTAACATCACGTCTTTGTCTCTAGTGCAGTTTTTCGAGA
TATTCCGTAGTACATATTTATTTTTAAACAACGACAAAGAAATACAGATATATCTTAAAAAAAAAAAGC
ATTTTGTATTAAAGAATTTAATTCTGATCTCAAAAAAAAAAAAAAAAAAAA

```
>gi|119637838|ref|NM_002498.2| Homo sapiens NIMA (never in mitosis gene a)-
related kinase 3 (NEK3), transcript variant 1, mRNA
```
CACATAGCTAGTAAGTTCTAGCTAGCACTGAGTGCTGTGCCCGTGAAATTTATCTACATAGGCTTTCACT
TAACCTGCAGACAGAACTCAGTTAGTCGGGGACAATTTCCCTCAATGTTAACAGCACTGTTCCACCGCAA
CGTGGAACAACAGCTTTAAAACGTGCTCTTCGTAGGCCCGGCTACTCCAAGAACAGTGCCTCCCGCCAGA
CCCAGGCGGCTTCCTTCACCCGCAACCCGAGAGACGACCCGCCGGGCCCGCCCCGCGGAAGCCGCCGGTT
GCCAGGCCAAGGAGTGGACTAGGGTCGCCGGGGAAGCGGTTTGGGAGAGCCCATGGTGACTGCGTGAGTG
GAGCCCAGCTGTGTGGATGCCCCAGCATGGATGACTACATGGTCCTGAGAATGATTGGGGAGGGCTCCTT
CGGCAGAGCTCTTTTGGTTCAGCATGAAAGCAGTAATCAGATGTTTGCCATGAAAGAAATAAGGCTTCCC
AAGTCTTTCTCTAATACACAGAATTCTAGGAAGGAGGCTGTTCTTTTAGCCAAAATGAAACACCCTAATA
TTGTTGCCTTCAAAGAATCATTTGAAGCTGAAGGACACTTGTATATTGTGATGGAATACTGTGATGGAGG
GGATCTAATGCAAAAGATTAAACAGCAGAAAGGAAAGTTATTTCCTGAAGACATGATACTTAATTGGTTT
ACCCAAATGTGCCTTGGAGTAAATCACATTCACAAGAAACGTGTGCTACACAGAGATATCAAGTCCAAGA
ATATCTTCCTCACTCAGAATGGAAAAGTGAAATTGGGAGACTTTGGATCTGCCCGTCTTCTCTCCAATCC
GATGGCATTTGCTTGTACCTATGTGGGAACTCCTTATTATGTGCCTCCAGAAATTTGGGAAAACCTGCCT
TATAACAATAAAAGTGACATCTGGTCCTTGGGTTGCATCCTGTATGAACTCTGTACCCTTAAGCATCCAT
TTCAGGCAAATAGTTGGAAAAATCTTATCCTCAAAGTATGTCAAGGGTGCATCAGTCCACTGCCGTCTCA
TTACTCCTATGAACTTCAGTTCCTAGTCAAGCAGATGTTTAAAAGGAATCCCTCACATCGCCCCTCGGCT

Figure 20 (Continued)

```
ACAACGCTTCTCTCTCGAGGCATCGTAGCTCGGCTTGTCCAGAAGTGCTTACCCCCCGAGATCATCATGG
AATATGGTGAGGAAGTATTAGAAGAAATAAAAAATTCGAAGCATAACACACCAAGAAAAAAAACAAACCC
CAGCAGAATCAGGATAGCTTTGGGAAATGAAGCAAGCACAGTGCAAGAGGAAGAACAAGATAGAAAGGGT
AGCCATACTGATTTGGAAAGCATTAATGAAAATTTAGTTGAAAGTGCATTGAGAAGAGTAAACAGAGAAG
AAAAAGGTAATAAGTCAGTCCATCTGAGGAAAGCCAGTTCACCAAATCTTCATAGACGACAGTGGGAGAA
AAATGTACCCAATACAGCTCTTACAGCTTTGGAAAATGCATCCATACTCACCTCCAGTTTAACAGCAGAG
GACGATAGAGGTGGTTCTGTAATAAAGTACAGCAAAAATACTACTCGTAAGCAGTGGCTCAAAGAGACCC
CTGACACTTTGTTGAACATCCTTAAGAATGCTGATCTCAGCTTGGCTTTTCAAACATACACAATATATAG
ACCAGGTTCAGAAGGGTTCTTGAAAGGCCCCCTGTCTGAAGAAACAGAAGCATCGGACAGTGTTGATGGA
GGTCACGATTCTGTCATTTTGGATCCAGAGCGACTTGAGCCTGGGCTAGATGAGGAGGACACGGACTTTG
AGGAGGAAGATGACAACCCCGACTGGGTGTCAGAGCTGAAGAAGCGAGCTGGATGGCAAGGCCTGTGCGA
CAGATAATGCCTGAGGAAATGTTCCTGAGTCACGCTGAGGAGAGGCTTCACTCAGGAGTTCATGCTGAGA
TGATCATGAGTTCATGCGACGTATATTTTCCTTTGGAAACAGAATGAAGCAGAGGAAACTCTTAATACTT
AAAATCGTTCTTGATTAGTATCGTGAGTTTGAAAAGTCTAGAACTCCTGTAAGTTTTTGAACTCAAGGGA
GAAGGTATAGTGGAATGAGTGTGAGCATCGGCTTTGCAGTCCCATAGAACAGAAATGGGATGCTAGCGT
GCCACTACCTACTTGTGTGATTGTGGGAAATTACTTAACCTCTTCAAGCCCCAATTTCCTCAACCATAAA
ATGAAGATAATAATGCCTACCTCAGAGGGATGCTGACCACAGACCTTTATAGCAGCCCGTATGATATTAT
TCACATTATGATATGTGTTTATTATTATGTGACTCTTTTTACATTTCCTAAAGGTTTGAGAATTAAATAT
ATTTAATTATGATTTA

>gi|88999578|ref|NM_002624.3| Homo sapiens prefoldin subunit 5 (PFDN5),
transcript variant 1, mRNA
GAGGATCATAGAGCTGTCTGGCGCAGCGAGGCCTCCCGGCGCCACCGAGACGCGCAGAGGACGGCTAGAG
CGTTGCTCGCCGAGAGACTTCCTCTTCGTTAAGTCGGCCTTCCCAACATGGCGCAGTCTATTAACATCAC
GGAGCTGAATCTGCCGCAGCTAGAAATGCTCAAGAACCAGCTGGACCAGGAAGTGGAGTTCTTGTCCACG
TCCATTGCTCAGCTCAAAGTGGTACAGACCAAGTATGTGGAAGCCAAGGACTGTCTGAACGTGCTGAACA
AGAGCAACGAGGGGAAAGAATTACTCGTCCCACTGACGAGTTCTATGTATGTCCCTGGGAAGCTGCATGA
TGTGGAACACGTGCTCATCGATGTGGGAACTGGGTACTATGTAGAGAAGACAGCTGAGGATGCCAAGGAC
TTCTTCAAGAGGAAGATAGATTTTCTAACCAAGCAGATGGAGAAAATCCAACCAGCTCTTCAGGAGAAGC
ACGCCATGAAACAGGCCGTCATGGAAATGATGAGTCAGAAGATTCAGCAGCTCACAGCCCTGGGGGCAGC
TCAGGCTACTGCTAAGGCCTGAGAGTTTTTGCAGAAATGGGGCAGAGGGACACCCTTTGGGCGTGGCTTC
CTGGTGATGGGAAGGGTCTTGTGTTTTAATGCCAATAAATGTGCCAGCTGGGCAGAAAAAAAAAAAAAAA
AAAAAAAAAAAAAAAAAAAAAAAAAAAAAAAAAAAAAAAAAAA >gi|209571525|ref|NM_003045.4| Homo sapiens solute carrier family 7 (cationic
amino acid transporter, y+ system), member 1 (SLC7A1), mRNA
GCACTGCTGATGAAACCTGGCGCCGGAACCCGCCAGCCCTCGGCGCCCATTCAGTCCGCGCAGGCAGGTG
TGAGCAGCGGGTCAACTACCTGGCAGGCGCGCACGCGGCCGCGGGCTCCCGCTAACCGCAGCCTCCACTC
CTCTCCCCGCGCGCCGCGCCCCGCCCCGCCCCGCCCCGCCCGGTCTCGCCGGCCGAGCGTCCGTTGGTC
CTTGAGCGCGTCCGACAGTCTGTCTGTTCGCGATCCTGCCGGAGCCCCGCCGCCGCGGCTTGGATTCTG
AAACCTTCCTTGTATCCCTCCTGAGACATCTTTGCTGCAAGATCGAGGCTGTCCTCTGGTGAGAAGGTGG
TGAGGCTTCCCGTCATATTCCAGCTCTGAACAGCAACATGGGGTGCAAAGTCCTGCTCAACATTGGGCAG
```

Figure 20 (Continued)

```
CAGATGCTGCGGCGGAAGGTGGTGGACTGTAGCCGGGAGGAGACGCGGCTGTCTCGCTGCCTGAACACTT
TTGATCTGGTGGCCCTCGGGGTGGGCAGCACACTGGGTGCTGGTGTCTACGTCCTGGCTGGAGCTGTGGC
CCGTGAGAATGCAGGCCCTGCCATTGTCATCTCCTTCCTGATCGCTGCGCTGGCCTCAGTGCTGGCTGGC
CTGTGCTATGGCGAGTTTGGTGCTCGGGTCCCCAAGACGGGCTCAGCTTACCTCTACAGCTATGTCACCG
TTGGAGAGCTCTGGGCCTTCATCACCGGCTGGAACTTAATCCTCTCCTACATCATCGGTACTTCAAGCGT
AGCGAGGGCCTGGAGCGCCACCTTCGACGAGCTGATAGGCAGACCCATCGGGGAGTTCTCACGGACACAC
ATGACTCTGAACGCCCCGGCGTGCTGGCTGAAAACCCCGACATATTCGCAGTGATCATAATTCTCATCT
TGACAGGACTTTTAACTCTTGGTGTGAAAGAGTCGGCCATGGTCAACAAAATATTCACTTGTATTAACGT
CCTGGTCCTGGGCTTCATAATGGTGTCAGGATTTGTGAAAGGATCGGTTAAAAACTGGCAGCTCACGGAG
GAGGATTTTGGGAACACATCAGGCCGTCTCTGTTTGAACAATGACACAAAAGAAGGGAAGCCCGGTGTTG
GTGGATTCATGCCCTTCGGGTTCTCTGGTGTCCTGTCGGGGGCAGCGACTTGCTTCTATGCCTTCGTGGG
CTTTGACTGCATCGCCACCACAGGTGAAGAGGTGAAGAACCCACAGAAGGCCATCCCCGTGGGGATCGTG
GCGTCCCTCTTGATCTGCTTCATCGCCTACTTTGGGGTGTCGGCTGCCCTCACGCTCATGATGCCCTACT
TCTGCCTGGACAATAACAGCCCCCTGCCCGACGCCTTTAAGCACGTGGGCTGGAAGGTGCCAAGTACGC
AGTGGCCGTGGGCTCCCTCTGCGCTCTTTCCGCCAGTCTTCTAGGTTCCATGTTTCCCATGCCTCGGGTT
ATCTATGCCATGGCTGAGGATGGACTGCTATTTAAATTCTTAGCCAACGTCAATGATAGGACCAAAACAC
CAATAATCGCCACATTAGCCTCGGGTGCCGTTGCTGCTGTGATGGCCTTCCTCTTTGACCTGAAGGACTT
GGTGGACCTCATGTCCATTGGCACTCTCCTGGCTTACTCGTTGGTGGCTGCCTGTGTGTTGGTCTTACGG
TACCAGCCAGAGCAGCCTAACCTGGTATACCAGATGGCCAGTACTTCCGACGAGTTAGATCCAGCAGACC
AAAATGAATTGGCAAGCACCAATGATTCCCAGCTGGGGTTTTTACCAGAGGCAGAGATGTTCTCTTTGAA
AACCATACTCTCACCCAAAAACATGGAGCCTTCCAAAATCTCTGGGCTAATTGTGAACATTTCAACCAGC
CTTATAGCTGTTCTCATCATCACCTTCTGCATTGTGACCGTGCTTGGAAGGGAGGCTCTCACCAAAGGGG
CGCTGTGGGCAGTCTTTCTGCTCGCAGGGTCTGCCCTCCTCTGTGCCGTGGTCACGGGCGTCATCTGGAG
GCAGCCCGAGAGCAAGACCAAGCTCTCATTTAAGGTTCCCTTCCTGCCAGTGCTCCCCATCCTGAGCATC
TTCGTGAACGTCTATCTCATGATGCAGCTGGACCAGGGCACCTGGGTCCGGTTTGCTGTGTGGATGCTGA
TAGGCTTCATCATCTACTTTGGCTATGGCCTGTGGCACAGCGAGGAGGCGTCCCTGGATGCCGACCAAGC
AAGGACTCCTGACGGCAACTTGGACCAGTGCAAGTGACGCACAGCCCCGCCCCCGGAGGTGGCAGCAGC
CCCGAGGGACGCCCCAGAGGACCGGGAGGCACCCCACCCTCCCCACCAGTGCAACAGAAACCACCTGCG
TCCACACCCTCACTGCAGCCAAAGGTGCAATTACTTGACCTGCAGCCCCAGCCCACCCTCGGCTCTGCAG
CCGGTTCTCCGGGCCCTGGTCACCTCCAGACAGCTGCCTGGCCGGGGCCACTAGGCTGCGGCTGGCCACT
GTGTCTCCTCACTTCTCTGAACAAAGCAGTTCCTCCCCTACCAGCTCAGCCCCGAGCTGCCGCAGCCTCA
GGCAGAACGGAGGTCACCTTCTCTCCTTATCTTGGGAACCAGGCCTTCCTCCCGGGGACTGTTCTGGGAT
TGAAATTGTGCATACTCCAAACTTTCGCAGCCATCTTCCCGCTCAGCCCCAGACACCCAGCAATCAAGCC
AGATGAGTACCACAAAACAGTGTGTCCCCAGCAGCTCCCCACCCCAGAGCCAAATGACAGTAGTGCACTT
AAAAAGGAAAATCAGGCCTGTTGTCCTTCTCCGGTTGCATTCAGATGGGTCATTAGGGCCGGACCCTGCC
TGCCCCTTGGCTTCTCAGGGCTTTGCTCTGACACCATGACAGCTGCCCGGGGCTGAGGGCAGCTGGCTCC
ACTCAAATGAGGAAGAAGGGATCACTCCCATTAGGGCCTGCTTTGCTTATGCATGTGTGCACATGCAT
GTAAACCAGGGACCTTCAGCTCACGGCCTCCAGGCCTGGGCCAGTTCTTGCTGCTCCTGCCGTCTCCCCC
GACTGGCTGTGTCCTGAGTAACTGGAACATGAGACAGTATCTGCAGGACTGGCCCCATGGTGGCCGAGTC
AGAAGTCTGTTTCCTGTGAGTCGCCACCGTTCACTCAGTCTTGCCCTCCCATGCTTTGGAGCCAGTCTGG
TGGCTCCTGTAAGGTTCTCAAGGCTGGTGGCAGCTCAGTCTGGGGTCAGGACATGTCGGGGTCATGCGTT
TCTGGCCCTGACATAAGCTGTCTGGCCTCTCTGTGACATGATGAAATTGAAATCAATCCACAGTCCATGA
```

Figure 20 (Continued)

```
AATTGTGACACTCCACCAGATTAAGTTAGGGCATAACATTAACTTGGAAATGGCCATGTCATCACCCCTG
CGGCTGTCCTATAGCTGAGATGCGTGGGTCGCAGGGGAGGTGATTTCTAGGCATATTGCTGTCCCTTTTG
TGTATCTGTCATCCGGATGCTTCGGACCCCACGCCTCTGCAAGTGGGAGAGACCCGAGCATCCTCCCCAC
CCCCATAGCTCCAGTGCACGCCACCCCCGTCTTGCCTGGGTCGGGGCCTGCGGCCAGCACCATTTCACAC
ACACTCCTTGTAGATGGGAGCCAGAGGAAACCTGAACGTGGGTGGAGCGTTCCACTGAGTCTACTTCAGG
AGACAGAAGGCCCATGCTGATGGGGAGGAGGAGGGATGTGGGCATTTTGGACACCAGGGGAAATGGAAA
TGCTGCTTTCAAAACTTAGTTTCCTTTCCATTTCTTCCTAGTCTGGCCTTTGACACAAATCTGGTAGAAA
GAAGCCTGATAAATTGAGGGCACTTGTACCCTCCCTGTGCCCCAGAAGGTTCTTGGAGAGAAGTGCAAG
AATTTGTGAACACGGCGGTGGAGGGCGGGTGGATGGCCATGGGCTGAGCCTCCGTATCAGGCCTGCTCAC
CTTGCTGGGAGCTTTATTCTGATCTCATTTTGAATGTTCCAGAGGGAGCATCATAAGAGCCCAGAGCTCC
GATTTCCAAAGAGTGATATTGACATTTATGGAGATTGGTGTTGTAACATATTTTGATAAATACTAACTTA
TTTTGTTGGGGTTTTGGTTGTCTCTTGTCTTAGGACCTGGTAGTTATTTGCTTGATTTTTTTTCCGTTA
TTTTCTACATAGGCAAAGAGAATTCGAGGGATAGACAGTCTCCAAGAAAAGTGAAGTGGTGGGAGAGAAT
TGCTTTTTTCTTTTTTTTCTTTTCTCTAGTTTTTCTTTCTGGCTGAGATTTCCGTGCAAGACAGCACCCA
ATAGACTATTTAGAGTTGACATTTGACATTTTAATGGGCGCCATGGCTCATTTTGTAGATTGAGAAGGTG
CGTCTCCCCTGCTCCAAGTCTCATCATGACAGCGTGCTGACAGCTGGGAGTCTGTGGCCTTCCTCACGCA
GAGGCCTTAAAGCTGGACACAGAAGCACGCCTAGGCTGGGCAGGGATGGGACCCATGCCCCCTCCTTAGA
GGACGGGCTTCCTGGTTAGGAAAGGACACGTGGGGGTGCCTTGCATAATAGTTCACTGGTCACCGTGCTT
TTATGAGTAGTGTTTTTGTGCACTTGCCAGGGGTTTTCTCTCTGTGTGAGAGGGGAGTGATTTAAGCAAT
GGTGTCTGGAGTAAGCCTTACAATTTTAATAGACTTTTTCTTATCATATCCCTCATTTCTTTCCCTGAAA
TAAAAATACACACAAGCAAAAAAAAAATGATAGTTTCACATCTCTTAGTTCCCTTGCCCAAACAAGAATA
TTCTTAGTTCCACTGGCCAGGATTTTCCTACATAGTCAGAACTTACACATTACTAGAGGCACACCCACCA
AGGAGTATTGTGTCTACTTTTATCTGTGCACCAGCCACAAATACCCACATTGGAAAGACCCATTTGTGAT
GGGTAAACATCCCTTCCTGTCTCCCACAACCCCTGTGACTGCCCTGCATGTGTTCATGACCTCCGAAGGC
CCAAATTCATGAAGCAGCAAACCCAGCAGATCTCCACCCCCCTGCCTCAGGACCTCTGCTGAAGAGGGGG
ATGAAGTGGGTCTCCAGGGAGGCAGTGGGGGCCTTGTTGGCAGCTGGCTCGGGAGCCGGCTTACAGGAGG
GCAGCTCTGCAGTTGGGAGGGGCACCGTCCGGAGGAGACCAGGCCTCTACACACCCCCCACTCTACTTAT
CATCCCTGCTCACACACCCTTGTCCAAGGCTTTATGCATCGGATTTATTTTTCCAAATCAAGAGGACAGT
GATAGATGCATTTTCCCCAGGCTGTCTCAGAAAGGTCGCTAAATGTATACTGTTGTCAGAATTGCTGAGA
TCTCCCCCCACTTTTGGTTTTTGCAGCAGTAAAAACTCTTTCCACTGTGACTTATTTTCTCTCTCAGGCA
GCCAGCCACCTGGTCCCTTGTGCTGACTCTAGCACAGTGGCCAGGATCCAATACGAGTCCAGGGGTGACC
GCAGGATGGTGGGGGCAGCGGGCTTCTCCACCTACCCCAGCCACCAAGGCCCTGACGCACTGCCTCCTGC
ACCTTCAGCACATCCCTGTGCACAGCTGGAAGGGTGCATGGCCCGCTCACCTTTGTTCAGATGGGTGGAA
ACGCTGATGATACCAGCTCCTCCCTGCCGTGCCCCTGCCACGGAGCAGGCATTGTGAACTGGCTGGTGTT
TGCAGTCCCACGTGGCATGGCCTCCAGCCCAACCCACAGTGGGAGACTGGAGACAGGGCAATGAGTCTGGT
GGGGGGCACGTGGACATGCCCCATAGGGGCCCCACCCAGACTTAACAGGCAAGGTCCTGGGCATTGCGCG
ACGCAGGACTCAATGCTAAAGCAAGCCTGCCTGGCTCTGTGCCAGGGCCCTCTTCTGATTCACACATCC
CATTTTTACACAGACCCTTCCTTCTTAATAAAGGCTGACAGTTCTGTTGGCAGCCAAGAACCCACACCAT
GAAGACAGGGAGTGAGGGCCTTTGTGCCCAACTCCAGCACAGCTGCGTTCTGGGGTGTGTGAGAGGCAT
GTTCGTGTCTGTGCGCTGGTGGTCTCGTGAGACAGTTCCGAGGACGGGGAAATTGCAGGGTGGTGGGGC
GTGAGGCTTATATGTGGAACTGATGCAGAGTTCGCCTGCAGACGGATCTGGATATACACTATGTATAATT
GTTACGTGTAATTTAAAATATATCTGTTTGCCATCGTCATGAGAAGATTATATGTAAGGCTCTGAAGGGA
```

Figure 20 (Continued)

```
GAGGGAGATGTACATTCTGCCAGGCTCCTGGGGACCTTATCCGAGTCATGAAATTGATTACTGTTGATCC
AGTGGTGCAAGAAGCTACACTCCATGTGTCATCACGCTTATGACTCCTAATGTATTTTTAAGGCAAAAAA
TGTCAGCCGACTCCATCTTCACCCCTCGATTCCTCGAGTCCAGCCTTTCTGTGCCAGTGCTTCACTGAGC
CACAACGCTCTCGCCATCGGGACCCGGCTGGGCCTGGAGTCTCGGGGCACAGTTGCCATGGAGCCCTCCT
GGGTCATTCTACAAATGTGCTGAGTGCCAGCTGAAAACCCCACAGGAGATGGAGTACCTTGGCCAAGCTT
AAAGAGAAGATTTTCTCAGGGTATTTATTAGTGTGTCCAGCAGGGTCAGGAAGCAGGATGGAAAGATGCA
CTCAGACTGTTAATTTATTAACAAGGCAAATGATTTTGTGTTTCTTGATGACAGACTATTAAGTTTGGGA
CTTATTTTCCCATTTGAGAAGTTATAATATATATTTAAGATGATAAGTTTCCTGCTTAAGTTGTGCCTTT
CAGCTTCAATGAGTTTAAGGAGCACTAAGGGTAATGATACCAATGAGGGTTGGTTTATTATCAAACCTGA
ATAGCTGTGGTTTCTCCAGTAAATATTTTCTTCTACTGAACATGGAGCCATTATTAAGAGTTGTGTGTTT
TTTATTATGTACATTTGTATATTTTTTGCTTGTTTGATGTTCTATTTTTCTAATAGTTTTCTTTTAGTT
TCTTAAAGTTGTGATACTAGATTTAGATTCTGATGCTAACTGCAAATCAGGTTGGTCTCTGCTGGGTCTC
TCCTGCTTTTATTTTACTTTAAGGACAAGTGTAGTTGTCGTCCACCACCTTTCAAAAAATGTGAAACTGC
CCTGCCTCCCCTTTTTGCTGACAACACTGTGTACATTGACCACTTCCTACCATACTTTATGTTGTAAAAT
CAAACTCTTTTGTGGTACATTATCTCATGCTTCTGCAAATTCGAATAAATTCTATGGCTTCCAAAAAAAA
AAAAAAA

>gi|124376992|ref|NM_003063.2| Homo sapiens sarcolipin (SLN), mRNA
AGTCCAGACAGCCTGGGAGGGGAGAAGGAGTTGGAGCTCAAGTTGGAGACAGCGAGGAGAAACCTGCCAT
AGCCAGGGTGTGTCTTTGATCCTCTTCAGGAGGTGAGGAGAAGCCAGAGGTCCTTGGTGTGCCCTCAGAA
ATCTGCCTGCAGTTCTCACCAAGCCGCTGTGAAAATGGGGATAAACACCCGGGAGCTGTTTCTCAACTTC
ACTATTGTCTTGATTACGGTTATTCTTATGTGGCTCCTTGTGAGGTCCTATCAGTACTGAGAGGCCATGC
CATGGTCCTGGGATTGACTGAGATGCTCCGGAGCTGCCTGCTCTATGCCCTGAGACCCCACTGCTGTCAT
TGTCACAGGATGCCATTCTCCATCCGAGGGCACCTGTGACCTGCACTCACAATATCTGCTATGCTGTAGT
GCTAGGATTGATTATGTGTTCTCCAAAGATGCTGCTCCCAAGGGCTGCCAAGTGTTTGCCAGGGAACGGT
AGATTTATTCCCCAACTCTTAACTGAAAATGTGTTAGACAAGCCACAAAGTTAAAATTAAACTGGATTCA
TGATGATGTAGGATTGTTACAAGCCCCTGATCTGTCTCACCACACATCCCTTCAACCCACACGGTCTGCA
ACCAAACTCTAATTCAACCTGCCAGAAGGAATGTTAGAGGAAGTCTTTGTCAGCCCTTATAGCTATCATG
TGAATAAAGTTAAGTCAACTTCAAAAACAAAAAAAAAA >gi|109134335|ref|NM_004844.3| Homo sapiens SH3-domain binding protein 5 (BTK-
associated) (SH3BP5), transcript variant 1, mRNA
GCGCCCATTTCCTCTGCTCCGCCGCGGCCGGAGGTATCCGCATCGGCGAGCTGCGTCTCCCGGGTGTCGG
CCCCGGCGGCTCCCCGACCGTGCCCGGCTGTGGCGAGGCGGCTCCAGCCCAGCCTGTGGCAGCCGCGACC
CCCGGGGCGCTCCGGAGCCCACTGCGCGGCGCGCGTGCCGGCTGCCTGCATGGACGCGGCACTGAAGCGG
AGCCGCTCGGAGGAGCCAGCCGAAATCCTGCCGCCTGCCCGGGACGAGGAGGAGGAGGAGGAAGAGGGGA
TGGAGCAGGGGCTGGAGGAGGAAGAAGAGGTGGATCCCCGGATCCAGGGAGAACTGGAGAAGTTAAATCA
GTCCACGGATGATATCAACAGACGGGAGACTGAACTTGAGGATGCTCGTCAGAAGTTCCGCTCTGTTCTG
GTTGAAGCAACGGTGAAACTGGATGAACTGGTGAAGAAAATTGGCAAAGCTGTGGAAGACTCCAAGCCCT
ACTGGGAGGCACGGAGGGTGGCGAGGCAGGCTCAGCTGGAAGCTCAGAAAGCCACGCAGGACTTCCAGAG
GGCCACAGAGGTGCTCCGTGCCGCCAAGGAGACCATCTCCCTGGCCGAGCAGCGGCTGCTGGAGGATGAC
AAGCGGCAGTTCGACTCCGCCTGGCAGGAGATGCTGAATCACGCCACTCAGAGGGTCATGGAGGCGGAGC
```

Figure 20 (Continued)

```
AGACCAAGACCAGGAGCGAGCTGGTGCATAAGGAGACGGCAGCCAGGTACAATGCCGCCATGGGCCGCAT
GCGACAGCTGGAGAAGAAACTCAAGAGAGCCATCAACAAGTCCAAGCCTTATTTTGAACTCAAGGCAAAG
TACTATGTGCAGCTCGAGCAACTGAAAAAGACTGTGGATGACCTGCAGGCCAAACTGACCCTGGCAAAAG
GCGAGTACAAGATGGCCCTGAAGAACCTGGAGATGATCTCAGATGAGATCCACGAGCGGCGGCGCTCCAG
TGCCATGGGCCTCGGGGATGCGGTGTTGGTGCTGAGGGCAGCAGCACATCTGTGGAGGATCTGCCAGGG
AGCAAACCTGAGCCTGATGCCATTTCTGTGGCCTCGGAGGCCTTTGAAGATGACAGCTGTAGCAACTTTG
TGTCTGAAGATGACTCGGAAACCCAGTCCGTGTCCAGCTTTAGTTCAGGACCAACAAGCCCGTCTGAGAT
GCCTGACCAGTTCCCTGCGGTTGTGAGGCCTGGCAGCCTGGATCTGCCCAGCCCTGTGTCCCTGTCAGAG
TTTGGGATGATGTTCCCAGTGTTGGGCCCTCGAAGTGAATGCAGCGGGGCCTCCTCCCCTGAATGTGAAG
TAGAACGAGGAGACAGGGCAGAAGGGGCAGAGAATAAAACAAGTGACAAAGCCAACAACAACCGGGGCCT
CAGCAGTAGCAGTGGCAGTGGTGGCAGCAGTAAGAGCCAAAGCAGCACCTCCCCTGAGGGCCAGGCCTTG
GAGAACCGGATGAAGCAGCTCTCCCTACAGTGCTCAAAGGGAAGAGATGGAATTATTGCTGACATAAAAA
TGGTGCAGATTGGCTGATTCATCCTGGGCCCTGGCCGATGTGCATATCAACATTTATACATGGAACTGGA
GAACATTGTGCCAATAATCATTTAATATATGCCAAATCTTACACGTCTACTCTAAACTGCTCTAATGAAG
TTTCAGTGACCTTGAGGGCTAAAGATTGTTCTTCTGGGTAAGAGCTCTTGGGCTGGTTTTTCAGAGCAGA
GTTCTTGTTGTGGGTAGACTGTGACTAGGTTCACAGCCTTTGTGGAACATTCCGTATAACGGCATTGTGG
AAGCAATAACTAGTTCCTATGAAAGAACCAGAGCTGGGAAGATGGCTGGGAAGCCAGGCCAAAGTGGGGG
CAACAGCTTGCTTCTCTTTCTCTTCTCACCCTCAGTTTGTATGGGAAAATGGAGATGTCCTCTCCACTTT
ATCCCACGATATCTAAATGAAAAGAAAGAAAACCCACACACAAAGCAAAAACTCAAGTATTAAGAGCAC
ATATTTTTGACCCAGTGGAGGCTTAAAAAAAAAAAAATCCAAGAACACAATTCATTTTCACCACCTCTGG
TGTTCAGAGGGGGCTTTTAAAAAAGCGTGTATGCTGGGATACCCATTAAAACCATTTTCTAGAAGGCTAC
CATGAGCTGCACTTTTTGGGGTGGGAAAGGTGAATGCCAGTGGGGATGCGGGGGATGAGGGTAGGAGGG
ACTTATAGAAGGGGATTTGTGGCTGTGGGGAGAAGGTTCTACAGCATAAGCCTTATCCTGCCAGCCAAG
GGGATTTATTCTAAGAGAAGTGCATGTGAAGAATGGTTGCCACTGTTATTAGATTGACAAGATGTTAATT
TCTCTGTAGGTTGTAACTTTAAAAATAAATGAAATTATTTAAGGGTTATGCTGCACTAGTATTCCTTAGA
GGAAACAGTTCTTTAAAGTTAGGAAAGGGAGTAGGCAGGCATGTGTTGGCAAAGGCTGTTAATAGTAGTT
AAGTGTTAAGACTGCTTTTCTTTAACGTTTTCATGGTAATGCATATTTAGAGCACTGTATTTTTGTCTTG
TTAAGAAAATTTAGCATTTCTAAAAGAAAAAAGCAACCCTCTTTCAAACTGTTAATTCTGTCACAGCCTG
TATATTTTAGTCATTTGTAAATCTCTTCATACAATAGTGACTTCTTTTTTGACTGATACAGTATCTTAAT
TACAAGGTTATTTTGTACTTGTCTTAATACACTAAGTGTAATAAAAACGGCTTGAGAAAAGTTAAAAAAA
AAAAAAAAA

>gi|52352808|ref|NM_005902.3| Homo sapiens SMAD family member 3 (SMAD3),
transcript variant 1, mRNA
GCGGCCGCCGCCTCCGCCCCGCGTTCGGGGCCTTCCCGACCCTGCACTGCTGCCGTCCGCCCGCCCGGCC
GCTCTTCTCTTCGCCGTGGGAGCCGCTCCGGGCGCAGGGCCGCGCGCCGAGCCCCGCAGGCTGCAGCGCC
GCGGCCCGGCCCGGCGCCCCGGCAACTTCGCCGAGAGTTGAGGCGAAGTTTGGGCGACCGCGGCAGGCCC
CGGCCGAGCTCCCCTCTGCGCCCCCGGCGTCCCGTCGAGCCCAGCCCCGCCGGGGCGCTCCTCGCCGCC
CGCGCGCCCTCCCCAGCCATGTCGTCCATCCTGCCTTTCACTCCCCCGATCGTGAAGCGCCTGCTGGGCT
GGAAGAAGGGCGAGCAGAACGGGCAGGAGGAGAAATGGTGCGAGAAGGCGGTCAAGAGCCTGGTCAAGAA
ACTCAAGAAGACGGGGCAGCTGGACGAGCTGGAGAAGGCCATCACCACGCAGAACGTCAACACCAAGTGC
ATCACCATCCCCAGGTCCCTGGATGGCCGGTTGCAGGTGTCCCATCGGAAGGGGCTCCCTCATGTCATCT
```

Figure 20 (Continued)

```
ACTGCCGCCTGTGGCGATGGCCAGACCTGCACAGCCACCACGAGCTACGGGCCATGGAGCTGTGTGAGTT
CGCCTTCAATATGAAGAAGGACGAGGTCTGCGTGAATCCCTACCACTACCAGAGAGTAGAGACACCAGTT
CTACCTCCTGTGTTGGTGCCACGCCACACAGAGATCCCGGCCGAGTTCCCCCCACTGGACGACTACAGCC
ATTCCATCCCCGAAAACACTAACTTCCCCGCAGGCATCGAGCCCAGAGCAATATTCCAGAGACCCCACC
CCCTGGCTACCTGAGTGAAGATGGAGAAACCAGTGACCACCAGATGAACCACAGCATGGACGCAGGTTCT
CCAAACCTATCCCCGAATCCGATGTCCCCAGCACATAATAACTTGGACCTGCAGCCAGTTACCTACTGCG
AGCCGGCCTTCTGGTGCTCCATCTCCTACTACGAGCTGAACCAGCGCGTCGGGGAGACATTCCACGCCTC
GCAGCCATCCATGACTGTGGATGGCTTCACCGACCCCTCCAATTCGGAGCGCTTCTGCCTAGGGCTGCTC
TCCAATGTCAACAGGAATGCAGCAGTGGAGCTGACACGGAGACACATCGGAAGAGGCGTGCGGCTCTACT
ACATCGGAGGGGAGGTCTTCGCAGAGTGCCTCAGTGACAGCGCTATTTTTGTCCAGTCTCCCAACTGTAA
CCAGCGCTATGGCTGGCACCCGGCCACCGTCTGCAAGATCCCACCAGGATGCAACCTGAAGATCTTCAAC
AACCAGGAGTTCGCTGCCCTCCTGGCCCAGTCGGTCAACCAGGGCTTTGAGGCTGTCTACCAGTTGACCC
GAATGTGCACCATCCGCATGAGCTTCGTCAAAGGCTGGGGAGCGGAGTACAGGAGACAGACTGTGACCAG
TACCCCCTGCTGGATTGAGCTGCACCTGAATGGGCCTTTGCAGTGGCTTGACAAGGTCCTCACCCAGATG
GGCTCCCCAAGCATCCGCTGTTCCAGTGTGTCTTAGAGACATCAAGTATGGTAGGGGAGGGCAGGCTTGG
GGAAAATGGCCATGCAGGAGGTGGAGAAAATTGGAACTCTACTCAACCCATTGTTGTCAAGGAAGAAGAA
ATCTTTCTCCCTCAACTGAAGGGGTGCACCCACCTGTTTTCTGAAACACACGAGCAAACCCAGAGGTGGA
TGTTATGAACAGCTGTGTCTGCCAAACACATTTACCCTTTGGCCCCACTTTGAAGGGCAAGAAATGGCGT
CTGCTCTGGTGGCTTAAGTGAGCAGAACAGGTAGTATTACACCACCGGCCCCCTCCCCCCAGACTCTTTT
TTTGAGTGACAGCTTTCTGGGATGTCACAGTCCAACCAGAAACACCCCTCTGTCTAGGACTGCAGTGTGG
AGTTCACCTTGGAAGGGCGTTCTAGGTAGGAAGAGCCCGCAGGGCCATGCAGACCTCATGCCCAGCTCTC
TGACGCTTGTGACAGTGCCTCTTCCAGTGAACATTCCCAGCCCAGCCCCGCCCCGCCCCGCCCCACCACT
CCAGCAGACCTTGCCCCTTGTGAGCTGGATAGACTTGGGATGGGGAGGGAGGGAGTTTTGTCTGTCTCCC
TCCCCTCTCAGAACATACTGATTGGGAGGTGCGTGTTCAGCAGAACCTGCACACAGGACAGCGGGAAAAA
TCGATGAGCGCCACCTCTTTAAAAACTCACTTACGTTTGTCCTTTTTCACTTTGAAAAGTTGGAAGGATC
TGCTGAGGCCCAGTGCATATGCAATGTATAGTGTCTATTATCACATTAATCTCAAAGAGATTCGAATGAC
GGTAAGTGTTCTCATGAAGCAGGAGGCCCTTGTCGTGGGATGGCATTTGGTCTCAGGCAGCACCACACTG
GGTGCGTCTCCAGTCATCTGTAAGAGCTTGCTCCAGATTCTGATGCATACGGCTATATTGGTTTATGTAG
TCAGTTGCATTCATTAAATCAACTTTATCATATGCTCTTTTAAATGTTTGGTTTATATATTTTCTTTAAA
AATCCTGGGCTGGCACATTGACTGGGAAACCTGAGTGAGACCCAGCAACTGCTTCTCTCCCTTCTCTCTC
CTGAGGTGAAGCTTTTCCAGGTTTTGTTGAAGAGATACCTGCCAGCACTTCTGCAAGCTGAAATTTACAG
AAGCAAATTCACCAGAAGGGAAACATCTCAGGCCAACATAGGCAAATGAAAAGGGCTATTAAAATATTTT
TACACCTTTGAAAATTGCAGGCTTGGTACAAAGAGGTCTGTCATCTTCCCCCTGGGATATAAGATGATCT
AGCTCCCGGTAGAGGATCACCGGTGACAACTATAGCAGTTGTATTGTGTAACAAGTACTGCTCCCAGCAG
CAATTAGGGAGAAAACTAGTCTAAATTATTTCAACTGGAAAAAAGAAAAAAGAGTCCTCTTCTTTTCCCA
GCCTTTTGCAGAACACAGTAGACAGAACTGCCACCTTCAATTGGTACTTTATTCTTTGCTGCTGTTTTTG
TATAAAATGACCTATCCCACGTTTTTGCATGAATTTATAGCAGGAAAAATCAAGGGATTTCCTATGGAAG
TCCTGCTTTATTCCAGGTGAAGGGAAGGAAGTGTATATACTTTTGGCAAGTCATACAGCTCAAATGTGAT
GAGATTTCTGATGTTAGAGGGAGATGGAGAGGCTTCCTGATGCCTCATCTGCAGGGTCCTGTGCCTCTGA
AGTTCTAGCCATGAGGTTTCCAGGTAGGACAGCTGCTCCCAAGCCTCCTGAGGACACAGGAAGAGACGG
AAGGAGCACCTTGACAGACTTGTGTGAGTCTTCTCGAAGGAGGGTTGACTCAGAACCCAGAGACAATACA
AAACCCCTCACTTCCTCTGAGAGGGCCAAATGCTGTGAGTCTGAAGTATGTGCCTGGTGTGAAATGATCT
```

Figure 20 (Continued)

ATGGCCTGTTTCTTACACAGGAAGCCCCCTGAACCTCCTGTACATGTGTTCATGTTCCCAGCCAGCTCTG
AGACCCAGGAACCAAATATTCCATTTTGGCTTCTGCTAGAGCAGTCATGGTTCCTCTCCTAAAAGCCATG
GGCAGCAGTTTCCGAGGGCCTGCATGATCCACCTGCTGCACGATCCTATGAGGGCTTCCTGTGGCACACA
GCCCTCTGGGTGCTTGGGAACTAGCTTCAGGCACAGCCTGATTCTGGTGATCCAGTGATCTATGGAAGTC
GTGTCTTACTCCAGGTGAAGGGGGAAAAAAAAAGCCTATACTTTGGCAGGTTATGAACTTTGAATGTGAT
GAAATGACACGTTTGGCTGCATTTGGATGGTGTCTTAGAACCCTCATTGCTCAGACCTGAAGGCTACTTC
TAGGAGCATGAAGTTTGAGTTTTGTGTTTTTCCAAAGGATACTTCCTTGGCCCTTTTTCTTTATTGACTA
GACCACCAGAGGAGGATGTGTGGGATTGTAGGCAAACCCACCTGTGGCATCACTGAAAATAAATTTGATC
ATACCTAAGAGGTTAGGAAATGGTGCCATTCCCACCTTAGAGTGCTACATAGGTGCTTTGGGCGTATGTA
ACATTAGTGTCCTTCCTTGAAGCCACAAGCTAGTTTTCTTAGTTTTAAAATCCTGTTGTATGAATGGCAT
TTGTATATTAAAACACTTTTTTAAAGGACAGTTGAAAAGGGCAAGAGGAAACCAGGGCAGTTCTAGAGGA
GTGCTGGTGACTGGATAGCAGTTTTAAGTGGCGTTCACCTAGTCAACACGACCGCGTGTGTTGCCCCTGC
CCTGGGCTCCCCGCCATGACATCTTCACCTTGCAGCTTGTGCTGAGACTGACCCAAGTGCAGCTAGCACT
GGGACACAGATCCTTGTCTTCAGCACCTTCCAAGGAGCCAACTTTTATTCCCTTTCCTCTCTCCCCTCCC
CACCTCGCTTCTTCCCAATTTAGTAACTTAGATGCTTCCAGCACATACGTAGGTAGCTACCCCAGCCGGT
TTGGATTACAGGCCTGTGCTGGAACATCATCTCAGTTGGCCACCTTCCTGGCAGGCTGTAGACCTGACAT
TTTGAGACAAGCCTAGAGTCAGGAGCAGGGACTTTGACTCTTAGGAAGAGCACACATGAGGGCAAGGCTG
CTGGCAGACGTCTCCATTGTCCTTATGTTGTCTGTGTTGTATTTTTTTTTTTTATTGACCATGGTGATT
ATTTTTTTAAACCATCGTTAATATACTGAAGTGAGCTATAGCACATATCATGTGCTTAGTTTGTTTATTT
TTCTCCATCTCCCCTTGGCTTCCTAGAGTTTGGACATATTCCAGGCTAAATGCTTTTACTCAAGACTACA
GAAAGGTTTGAAGTAGTGTGTGCATGGCATGCACGTATGTAAGTAATCTGGGGAAGAAGCAAAGATCTGT
TTCATTCTTAGCCTCAGGCCTCATGAGGGTCTCCACAGGGCCGGAGCTCAGGTTACACCACTCCTTCGTC
CTTACAGGAGATGTAGGGAGAAGAATCTGCAGGCTGCTTGTAGGACTGTTCACCAAGGGGGATACCAGCA
GCAAGAGAGTGCACCCGTTTAGCCCTGGACCCTGTTTCTTACTGTGTGACTTGGCTAGAGTTGGGAGTTC
CCCCAAAATAAACGTGTCCCCATTTTACCAGAACCAAACCTCAACACAGCGAAGCTGTACTGTCTTTGTG
TGGCAAAGATGTTCCCTTGTAGGCCCCTTTCAGGTAACCGTCTTCACAATGTATTTTCATCACAGTTTAA
GGAGCATCAGCCGCTTCTCAAGTGGGTAGGGAAAGCAGAAAAACGTACGCAAGAGGACATGGATCCAAAA
TGATGATGAAGCATCTCCCATGGGAGGTGATGGTGGGAGATGATGGGCTAAACAGGCAACTTTTCAAA
AACACAGCTATCATAGAAAAGAAACTTGCCTCATGTAAACTGGATTGAGAAATTCTCAGTGATTCTGCAA
TGGATTTTTTTTTAATGCAGAAGTAATGTATACTCTAGTATTCTGGTGTTTTTATATTTATGTAATAATT
TCTTAAAACCATTCAGACAGATAACTATTTAATTTTTTTAAGAAAGTTGGAAAGGTCTCTCCTCCCAAG
GACAGTGGCTGGAAGAGTTGGGGCACAGCCAGTTCTGAATGTTGGTGGAGGGTGTAGTGGCTTTTTGGCT
CAGCATCCAGAAACACCAAACCAGGCTGGCTAAACAAGTGGCCGCGTGTAAAAACAGACAGCTCTGAGTC
AAATCTGGGCCCTTCCACAAGGGTCCTCTGAACCAAGCCCCACTCCCTTGCTAGGGGTGAAAGCATTACA
GAGAGATGGAGCCATCTATCCAAGAAGCCTTCACTCACCTTCACTGCTGCTGTTGCAACTCGGCTGTTCT
GGACTCTGATGTGTGTGGAGGGATGGGGAATAGAACATTGACTGTGTTGATTACCTTCACTATTCGGCCA
GCCTGACCTTTTAATAACTTTGTAAAAAGCATGTATGTATTTATAGTGTTTTAGATTTTTCTAACTTTTA
TATCTTAAAAGCAGAGCACCTGTTTAAGCATTGTACCCCTATTGTTAAAGATTTGTGTCCTCTCATTCCC
TCTCTTCCTCTTGTAAGTGCCCTTCTAATAAACTTTTCATGGAAAAGCTCCTGTGCCAGGAGCTCAGTCT
GAAAAAAAAAAAAAAAAAAAAAAAA

Figure 20 (Continued)

\>gi|83281448|ref|NM_006214.3| Homo sapiens phytanoyl-CoA 2-hydroxylase (PHYH),
transcript variant 1, mRNA
AGTCCGGGCGGCGCCTGGAGGCGGAGCCGCCCGCTGGGCTAAATGGGGCAGAGGCCGGGAGGGGTGGGG
GTTCCCCGCGCCGCAGCCATGGAGCAGCTTCGCGCCGCCGCCCGTCTGCAGATTGTTCTGGGCCACCTCG
GCCGCCCCTCGGCCGGGGCTGTCGTAGCTCATCCCACTTCAGGGACTATTTCCTCTGCCAGTTTCCATCC
TCAACAATTCCAGTATACTCTGGATAATAACGTTCTAACCCTGGAACAGAGAAAATTTTATGAAGAAAAT
GGGTTTCTAGTAATCAAAAATCTTGTACCTGATGCCGATATTCAACGCTTTCGGAATGAGTTTGAAAAAA
TCTGCAGAAAGGAGGTGAAACCATTAGGATTAACAGTAATGAGAGATGTGACCATTTCGAAATCCGAATA
TGCTCCAAGTGAGAAGATGATCACGAAGGTCCAGGATTTCCAGGAAGATAAGGAGCTCTTCAGATACTGC
ACTCTCCCCGAGATTCTGAAATATGTGGAGTGCTTCACTGGACCTAATATTATGGCCATGCACACAATGT
TGATAAACAAACCTCCAGATTCTGGCAAGAAGACGTCCCGTCACCCCTGCACCAGGACCTGCACTATTT
CCCCTTCAGGCCCAGCGATCTCATCGTTTGCGCCTGGACGGCGATGGAGCACATCAGCCGGAACAACGGC
TGTCTGGTTGTGCTCCCAGGCACACACAAGGGCTCCCTGAAGCCCCACGATTACCCCAAGTGGGAGGGGG
GAGTTAACAAAATGTTCCACGGGATCCAGGACTACGAGGAAAACAAGGCCCGGGTGCACCTGGTGATGGA
GAAGGGCGACACTGTTTTCTTCCATCCTTTGCTCATCCACGGATCTGGTCAGAATAAAACCCAGGGATTC
CGGAAGGCAATTTCCTGCCATTTCGCCAGTGCCGATTGCCACTACATTGACGTGAAGGGCACCAGTCAAG
AAAACATCGAGAAGGAAGTTGTAGGAATAGCACATAAATTCTTTGGAGCTGAAAATAGCGTGAACTTGAA
GGATATTTGGATGTTTCGAGCTCGACTTGTGAAAGGAGAAAGAACCAATCTTTGAAATAGCCATCTGCTA
TAACTCTTTCAACAGAAAACCAAAACCAAACGAAATGTCTAAGGAAAATGTTTTCTTAATGAGATGATGT
AACCTTTTCTATCACTTGTTAAAAGCAGAAAACATGTATCAGGTACTTAATTGCATAGAGTTAGTTTTGC
AGCACAATGGTGTTGCTTTAATGGAAAAAAAAAACAGTAAAAGTGAAATATTACTGTTTTAAGGAAAACT
AATTTAGGGTGGCAGCCAATAAAGGTGGTTGGTGTCTAATTTAAGTGTTAAATCAATTTCTTTCATTCAG
TTAGCTCTTTACCCAAGAAGAAGTGAATGATTTGGAGCTTAGGGTATGTTTTGTATCCCCTTTCTGATAA
ACCCATTCCCTACCAATTTTATGTCATAAGAGATTTTTTTCCCCCAAATCTAGAACAATGTATAATACAT
TCACATCTAGTCAAGGGCATAGGAACGGTGTCATGGAGTCCAAATAAAGTGGATATTCCTGCTCGGACAA
AAAAAAAAAA \>gi|31083295|ref|NM_006246.2| Homo sapiens protein phosphatase 2, regulatory
subunit B', epsilon isoform (PPP2R5E), mRNA
GGTTGCGCGTGTGCCATGGACTCAGCCGCCCGGTGATATTGACAATAGGAGAGAGAAAGGGGCATTGACT
GGGACCCACCGCGGGTAGCGAAAGGTGGCTCTGGCAGCGGCGGCTCCAGCTCCTGCGGCTCCTCCTCCTT
ATTCTGTCCCCTTCTCTTGCTGCCGCTGCAGATCCAGTCTTCCTCCCTCCCTTCCCCCCCTCCCCACGTC
GTCGCCGCCGCCGCCGGGTCCGGGGCAACGAGCTGAGGCGCCGCCCGCCAGGAATGTGAGCGAGGAGCCA
CCGGCGGAGCCGCAACGGGGTCGGTGCCGATTTGATGGGACGGGCCCGCGGGGGAGGATCGTGAGGCCGC
CGCCGCCACCGGAACGCTGAGGTTCGGGTCCGGCCGTGAGGCCTAGAGGCTCCGCCGCCGCGGAACCGGA
GGGACCCCGTACCGGACAGCCGTCGCCCCAGGCTCCCCGCAGCTGCCCGGACCTCCCCCTGCACGTCCCG
GTCCCGCCGCCCGCCCCCGCTGCGGCCACCTCGCCCGTCTCCCGCCCCTCCAAGCCACAGATCATCTTTG
GATTCTTCCCCAGAAGCTTCAAGTAGGGATATGTCCTCAGCACCAACTACTCCTCCATCAGTGGATAAAG
TAGACGGATTTTCTCGGAAGTCCGTCAGAAAAGCCAGACAGAAGAGGTCGCAAAGTTCCTCACAGTTTAG
GTCTCAAGGCAAGCCTATTGAGTTAACACCTCTGCCGCTGCTAAAAGACGTTCCATCCTCAGAGCAGCCT
GAACTGTTCCTAAAGAAACTTCAGCAGTGCTGTGTCATTTTTGACTTCATGGACACGCTATCTGATCTTA
AAATGAAAGAATACAAGCGCTCCACTCTTAATGAACTGGTGGACTACATTACAATAAGCAGAGGCTGTTT

Figure 20 (Continued)

```
GACAGAGCAGACTTACCCTGAAGTAGTTAGAATGGTATCTTGCAATATATTCAGAACTCTCCCTCCTAGT
GACAGCAATGAATTTGATCCAGAAGAAGATGAACCTACCCTTGAGGCATCGTGGCCACACTTACAGCTTG
TATATGAATTTTTCATACGATTTTTGGAAAGCCAAGAATTCCAACCCAGCATTGCCAAAAAATATATAGA
TCAGAAATTTGTATTACAGCTTCTGGAGCTATTTGACAGCGAAGACCCTCGGGAACGGGACTACTTAAAA
ACAGTCTTACACAGAATTTATGGCAAGTTTCTTGGTCTTAGAGCATTTATCCGAAAACAGATTAACAATA
TTTTTCTAAGGTTTGTTTATGAAACAGAACACTTCAATGGTGTAGCTGAACTGCTGGAAATATTAGGAAG
TATTATCAATGGCTTTGCTTTACCTCTTAAGGCAGAACACAAACAGTTTCTGGTGAAAGTATTGATCCCT
TTACACACTGTCAGGAGCTTATCACTCTTCCATGCACAGCTGGCATATTGTATAGTACAGTTTCTGGAGA
AAGATCCTTCACTCACAGAACCAGTTATTAGGGGGTTAATGAAATTTTGGCCTAAAACATGTAGTCAAAA
AGAGGTCATGTTCCTTGGGGAACTGGAAGAAATATTGGATGTGATTGAACCTTCACAATTTGTTAAAATC
CAAGAACCTTTGTTTAAACAAATCGCCAAGTGTGTATCTAGCCCCCATTTTCAGGTGGCAGAAAGAGCAC
TCTATTATTGGAATAATGAATACATCATGAGTTTGATAGAAGAAAACTCTAACGTCATCCTTCCCATCAT
GTTTTCCAGCCTTTATAGGATTTCAAAAGAACATTGGAATCCGGCTATTGTGGCGTTGGTGTACAATGTG
TTGAAGGCATTTATGGAAATGAACAGCACCATGTTTGACGAGCTGACAGCCACATACAAGTCAGATCGTC
AGCGTGAGAAAAAGAAAGAAAAGGAGCGTGAAGAATTGTGGAAAAAATTGGAGGATCTGGAGTTAAAGAG
AGGTCTTAGACGTGATGGAATAATTCCAACTTAACAAAAACAATGACAACAACATTACTAACCTGTGGAG
TCACACGTTTATGTAGTAGAAGATGGAGCAACAGTTTTCTGTATTGTGCAACTTTACAGTAGATTTCACC
TTTGTTTCATTATTACAGCAGCACTGTATATACCTGTCTCTAAGTAAAGGAAAAAACAAAATAAGGACTT
CAATCCAAAGTTTGGACAGTAGATGGACTTCTCAGAACTTTGCAAACATAATCATTGTTCTCACCCTCTT
TTAAAAAAAAAAATCGGTCTTCAAAGATCTGTTGATGAAATTGCTATGTTAAAATTCCATTATCGGGAGT
TCCTTATTTATCACTAGCAGAGAGTATGATACAATTTTCAAATGTGAACAATCTTAAATTTAGCTTGTCT
TTCTGCTAAGCTGTTAAATGTATTTATAGTAAAGGAAGAAAAAAAGACTGTCATTTCCTTATAAGTTTGT
GTAACATCCTCCTCTGGATAACTTGACTGTAATTTAACATCTTTTTCTTTTGCACATCTTCCTGAGTTGA
ATGTCCACGTGGAATGGGGTCATGAATTATAAAAGTCCCTGATAAAAGTTTTGTTTACTGGGGTGAACAT
CTTTCCAGTAACCAGGTAGTCCTGGTACTCCTTTAGTTTTAAAATTAGGAGTTAAGAGAGAAGAGGTGAT
AAACATAGTAGGGAAGGGAATATCGGATTCATGCATCAGTTTATGGTGAATCCAAATCAATGTCTTGAAT
CCTTTGAAAACAGGCACTGGGACATCACAGGCTTCAGTACCTGACCAGTATTAGTTGCATATATCATTGA
ACACACATACCAGAGATGTTTTAGAAATGTGAGAAAAACATCCTTTTGGACCATTTGAAATAAGAAAGAC
AAACACTAAACAATACAACCATGAAATTGATCACCGGGATTGCAAATCTAATTGGGAAAGAGTTGAGCA
AACAGCTTGGACTGTTTGGAGTTGTTGCCTTACTTTTTAATATGTATTTATAAAGTATTCCAGCAAAAGA
GGATGTAGCCTCTGGGAAAAAACAAACATGTTACAGTGTTTTTTGTAGATTCTCGTTCTATATCTCATCA
CAGCGCCAGCCCTGTTTTTAGCCGGAAAGGATTCAGGATAAACATTATTATGCATTCTGAATTGGATGCA
TATTCCTAACTACTGTATTTGTTACCAAAAGTGGTTCTACAAATGCTACTGAAAAAAATCGGAAATTCC
TAATGTCCTGAGTATTAATAATAAAGTTTAAAAATGCTTTTATATCAAAGGTGCATCGTGACCAAATTGT
TTAAGAAAAAAAACAAAAAAAACAAAATCTAGGGCTGTATTTTATATATATATATATATATATATATAT
ATATAT

>gi|141801742|ref|NM_006468.6| Homo sapiens polymerase (RNA) III (DNA directed)
polypeptide C (62kD) (POLR3C), mRNA
GTCTTCTTCGGTGGCGATCCGCGTCCTAGAAAGGGCGGTGGGCTCCACCTCGGCCTAGAAGGCCAGCGGG
AGCCGTAGGAAGCCGTCGCGGGAAGCTCAGCCGAATTGGAGTTGGAGCCCCCGGATTGCGCTGACCCTGA
GCTCTCAGACTCCCCAGTACAATGACTCAAGCAGAAATTAAGCTCTGTTCTTTGTTGCTGCAAGAGCATT
```

Figure 20 (Continued)

```
TTGGAGAGATTGTAGAAAAAATTGGAGTCCATCTGATAAGAACCGGCAGCCAGCCACTAAGAGTAATTGC
CCATGACACAGGAACATCACTGGATCAGGTGAAGAAAGCCCTGTGTGTCCTCGTCCAACATAACCTGGTG
AGTTATCAAGTGCACAAACGTGGTGTGGTGGAGTATGAAGCCCAGTGCAGCCGGGTATTGCGAATGCTTA
GATATCCCCGGTACATCTATACTACCAAAACTCTGTACAGTGACACTGGAGAGCTGATTGTTGAGGAGCT
TCTGTTGAACGGCAAACTGACAATGTCAGCTGTTGTGAAGAAAGTGGCAGACCGGCTCACAGAGACCATG
GAGGATGGCAAGACCATGGACTATGCTGAAGTATCAAACACATTTGTGCGACTGGCAGACACACACTTTG
TACAACGCTGCCCTTCGGTACCTACCACTGAGAATTCAGACCCTGGGCCACCACCACCTGCCCCCACACT
TGTCATTAATGAAAAGGACATGTACCTGGTTCCTAAACTCAGCTTGATAGGGAAAGGTAAAAGGAGGAGA
TCATCTGATGAAGATGCTGCTGGGGAGCCCAAGGCCAAGAGACCAAAATATACTACAGATAACAAGGAGC
CCATTCCAGATGATGGATTTATTGGCAGGCCAACCTTGACAGATTCCACCAACACTTCCGTGACCAAGC
CATTGTGAGCGCAGTTGCTAACAGGATGGACCAGACAAGCAGCGAGATTGTGCGAACCATGCTCCGAATG
AGTGAGATTACCACTTCCTCTAGTGCTCCCTTCACCCAGCCATTGTCTTCCAATGAGATCTTCAGATCCC
TACCTGTTGGCTATAACATCTCTAAGCAAGTTCTTGATCAGTATCTCACTCTGCTGGCAGATGATCCACT
AGAGTTTGTTGGAAAGTCTGGCGACAGTGGTGGAGGAATGTATGTCATCAACCTCCATAAGGCATTAGCA
TCCCTAGCCACAGCCACTCTGGAGTCCGTCGTACAGGAGAGATTTGGGTCTCGCTGTGCTAGAATATTCC
GTCTAGTTTTGCAGAAGAAACACATAGAGCAGAAGCAAGTGGAAGACTTTGCAATGATTCCTGCAAAGGA
GGCAAAGGATATGCTATATAAGATGCTCTCAGAAAATTTCATGTCACTCCAGGAAATTCCCAAAACACCA
GACCATGCCCCATCCAGGACCTTCTATTTATATACTGTGAACATCCTGTCAGCTGCCCGAATGTTGTTGC
ACAGGTGCTACAAGAGCATAGCCAACTTGATAGAAAGGAGGCAATTTGAAACCAAAGAGAATAAGCGTCT
ACTAGAAAAATCTCAGAGGGTAGAAGCCATCATTGCATCTATGCAGGCTACTGGTGCAGAGGAAGCACAG
TTACAAGAAATAGAGGAGATGATCACAGCTCCTGAACGTCAGCAGCTAGAGACCCTGAAACGTAATGTCA
ACAAGTTGGATGCCAGTGAGATCCAGGTGGACGAAACCATCTTCCTGCTGGAGTCTTACATTGAGTGCAC
CATGAAGAGACAGTGATCCAGAAGAAGCATCTTCCTCAGAAGATCTGGGGGGATGGAAAGCAAAATAAAG
GAGGTGCCTGGATGCATTATTTGCAGTGGGAAAAAAAAAAAAAAAAAAAAAAAAAAAAAAAAAAAAAAA

>gi|56682941|ref|NM_006480.4| Homo sapiens regulator of G-protein signaling 14
(RGS14), mRNA
TAGAGACACTTCCTGTGGCAGAGAAAAGAGGTAGTGAGCGGTGTTTCAGGATGTGAGGGCCCGCAGGAGC
CGAGTCAGGCTCTCTCCACTGCCTGCCCGCCACCGTGCAAGCTCTGGCCGGCGCTGCCCACAGTCCCCAT
GGTGGGCAGCCCCCGCGGCGGGGACCCCTGATCGGCAGCGGCATGCCAGGGAAGCCCAAGCACCTGGGCG
TCCCCAACGGGCGCATGGTTCTGGCTGTGTCAGATGGAGAGCTGAGCAGCACGACGGGGCCCCAGGGCCA
GGGCGAGGGCCGCGGCAGCTCTCTCAGCATCCACAGCCTCCCCAGTGGTCCCAGCAGCCCCTTCCCAACC
GAGGAGCAGCCTGTGGCCAGCTGGGCCCTGTCCTTCGAGCGGCTGTTGCAGGACCCGCTGGGCCTGGCTT
ACTTCACTGAGTTCCTGAAGAAGGAGTTCAGCGCGGAAAACGTGACTTTCTGGAAGGCCTGCGAGCGCTT
CCAGCAGATCCCGGCCAGCGATACCCAGCAGCTAGCTCAGGAGGCCCGCAACATCTACCAGGAGTTCCTG
TCCAGCCAGGCGCTGAGCCCAGTGAACATCGACCGTCAGGCCTGGCTTGGCGAGGAGGTGCTGGCCGAGC
CCCGGCCGGACATGTTTCGGGCACAGCAGCTTCAGATCTTCAACTTGATGAAGTTCGACAGCTATGCGCG
CTTCGTCAAGTCCCGCTGTACCGCGAGTGCCTGCTAGCCGAAGCCGAGGGACGCCCTCTGCGGGAACCT
GGCTCCTCGCGCCTCGGCAGCCCTGACGCCACGAGGAAGAAGCCGAAGCTGAAGCCCGGGAAGTCGCTGC
CGCTGGGTGTGGAGGAGTTGGGGCAGCTGCCACCCGTTGAGGGTCCTGGGGGCCGCCCTCTCCGCAAGTC
CTTCCGCCGGGAGCTGGGCGGGACTGCAAACGCCGCCTTGCGCCGAGAGTCTCAGGGCTCCCTCAACTCC
TCCGCCAGCCTGGACCTTGGCTTCCTAGCCTTCGTCAGCAGCAAATCTGAGAGCCACCGGAAGAGCCTTG
```

Figure 20 (Continued)

```
GGAGCACGGAGGGTGAAAGTGAAAGCCGGCCAGGGAAGTACTGCTGTGTGTACCTGCCCGATGGCACAGC
CTCCTTGGCCCTGGCCAGACCTGGCCTCACCATCCGAGACATGCTGGCAGGGATCTGTGAGAAACGAGGC
CTCTCTCTACCTGACATCAAGGTCTACCTGGTGGGCAATGAACAGGCCCTGGTCCTGGATCAGGACTGCA
CCGTGCTGGCGGATCAGGAAGTGCGGCTGGAAAACAGGATCACCTTCGAGCTGGAGCTGACGGCGCTGGA
GCGCGTGGTACGAATCTCAGCCAAGCCCACCAAGCGGCTGCAGGAGGCGCTGCAGCCCATTCTGGAGAAG
CACGGCTTGAGCCCGCTAGAGGTGGTGCTGCACCGGCCAGGCGAGAAACAGCCTCTGGATCTGGGGAAGC
TAGTGAGCTCGGTGGCGGCCCAGAGACTGGTTTTGGACACTCTTCCAGGTGTGAAGATCTCCAAAGCCCG
TGACAAATCTCCCTGCCGCAGCCAGGGCTGCCCACCTAGAACTCAGGATAAGGCCACCCATCCCCCTCCA
GCGTCCCCCAGTTCTCTGGTGAAGGTGCCCAGTAGTGCCACTGGAAAGCGGCAGACCTGTGACATCGAAG
GCCTGGTGGAGCTGCTGAACCGGGTGCAGAGCAGCGGGGCCCACGACCAGAGGGGCCTTCTGAGGAAAGA
GGACCTGGTACTTCCAGAATTTCTGCAGCTGCCCGCCCAAGGGCCCAGCTCCGAGGAGACCCCACCACAG
ACCAAATCAGCAGCCCAGCCCATCGGGGATCCTTGAACTCCACCACCGACTCAGCCCTCTGACAGCTAC
CCAACAGTCCAGGACAGCTGCATGGCACCCGGCGGGCCGAGCATGCCATGGGTCCGCTCTGCATGCCCTG
TCTGTGCCATGAGTGTCCCTGGCCCCTTCCTGCCATGGGCAGGCCCGCAGGAAGAGCCGGTAGGGGTGGA
AAGGGGACTCAGATGAGACACACCCCACAGCTGCCACCGCCTTGTCCCTCAACAAGCTCACCCCCAATCC
CTTGCAGCCAGGCCACAATGGGGGAGGTGAGTCCAGCCCCTTGGAACAGGCTTGCCCAACATGGAGGGAT
GGCGTTGGCAGTGCCAGCCTCCCCAGCCTGTGCCAAGCTTCAACAGGGGCAAGAGGAGGGGCCGGCCCCT
CCTCAGGAAGCTGGTATGAGTAAGGCCTTGAGGGTGCAGGCAGGCAGCCCTGTACCCCACCCACATAGAC
TATACTGTACATACAGATTTTGCAGTAGGCTTGGGCAGCTGGGTTTGTCCTTGATGTATGATACTGTTA
TTATAATAATTATTATTATTCTGCCAAAAAAAAAAAAA

>gi|51173752|ref|NM_006498.2| Homo sapiens lectin, galactoside-binding, soluble,
2 (LGALS2), mRNA
GACCTTGAGGGAGTTAATGTGTAATATTCTAGGATATAAGCTTGACCACGAGTTGAGACCCTGAGCACAG
GCCTCCAGGAGCCGCTGGGAGCTGCCGCCAGGAGCTGTCACCATGACGGGGGAACTTGAGGTTAAGAACA
TGGACATGAAGCCGGGGTCAACCCTGAAGATCACAGGCAGCATCGCCGATGGCACTGATGGCTTTGTAAT
TAATCTGGGCCAGGGGACAGACAAGCTGAACCTGCATTTCAACCCTCGCTTCAGCGAATCCACCATTGTC
TGCAACTCATTGGACGGCAGCAACTGGGGGCAAGAACAACGGGAAGATCACCTGTGCTTCAGCCCAGGGT
CAGAGGTCAAGTTCACAGTGACCTTTGAGAGTGACAAATTCAAGGTGAAGCTGCCAGATGGGCACGAGCT
GACTTTTCCCAACAGGCTGGGTCACAGCCACCTGAGCTACCTGAGCGTAAGGGGCGGGTTCAACATGTCC
TCTTTCAAGTTAAAAGAATAAAAGACTTCCAGCCGAGAAAAAAAAAAAAAAAA >gi|38492355|ref|NM_006591.1| Homo sapiens polymerase (DNA-directed), delta 3,
accessory subunit (POLD3), mRNA
AGACGTTTCCCGCCGGCGGGAGCTGTGGCTGTGATTGAGAGAGGGGTTAGAGGCGGGTCCCAGCGCTGCC
GCACCATGGCGGACCAGCTTTATCTGGAAAATATAGACGAGTTCGTCACGGACCAAAACAAGATCGTGAC
ATACAAATGGCTGAGCTATACACTAGGGGTTCATGTTAACCAGGCCAAACAGATGCTGTATGATTATGTT
GAAAGGAAACGAAAAGAAAATTCAGGAGCCCAACTGCATGTTACCTACTTGGTGTCTGGCAGTCTCATTC
AGAATGGACATTCCTGCCACAAGGTTGCAGTAGTGAGAGAAGATAAATTGGAAGCAGTGAAGTCCAAGCT
AGCTGTGACTGCCAGCATCCATGTGTACAGCATCCAGAAAGCCATGCTAAAGGACAGTGGGCCTCTGTTC
AATACTGACTATGACATCCTTAAAAGCAACTTGCAGAACTGCAGCAAATTTAGTGCTATACAATGTGCAG
CTGCCGTCCCTAGAGCTCCTGCTGAATCCTCTTCGTCTTCCAAAAAGTTTGAGCAGTCACATCTTCACAT
```

Figure 20 (Continued)

```
GTCAAGTGAGACACAAGCCAACAATGAGCTGACCACCAATGGTCATGGCCCACCTGCATCCAAGCAGGTT
TCCCAGCAGCCCAAAGGAATTATGGGAATGTTTGCCTCCAAAGCTGCTGCTAAAACCCAAGAAACCAACA
AGGAAACGAAAACAGAGGCTAAAGAAGTAACAAATGCATCTGCAGCAGGCAACAAGGCACCAGGGAAAGG
GAATATGATGAGCAACTTTTTGGAAAAGCTGCTATGAATAAATTTAAAGTCAATTTGGACTCAGAACAA
GCAGTGAAAGAAGAAAAAATAGTGGAGCAGCCTACAGTGTCTGTCACGGAACCAAAGCTGGCAACTCCTG
CAGGCCTGAAAAAATCCAGCAAAAAAGCAGAGCCTGTTAAGGTGCTGCAGAAGGAAAAAAAAGGGGGAA
GCGAGTAGCATTATCTGATGATGAGACAAAGGAAACTGAAAACATGAGGAAAAAGAGGAGAAGAATCAAA
CTTCCTGAATCTGATAGCAGTGAAGATGAAGTCTTTCCAGACTCTCCTGGGGCTTATGAAGCTGAGTCAC
CATCCCCACCTCCTCCTCCGTCTCCACCTCTTGAACCAGTGCCAAAGACTGAGCCTGAACCTCCTTCTGT
CAAGAGCTCAAGTGGAGAAAACAAAAGAAAACGAAAACGCGTACTAAAATCTAAAACTTACCTGGATGGG
GAAGGCTGCATAGTGACTGAAAAAGTCTACGAGAGTGAATCCTGCACAGATAGTGAAGAGGAGCTTAACA
TGAAGACATCCTCAGTACACAGACCCCCTGCCATGACTGTGAAAAAAGAACCCAGAGAGGAACGAAAGGG
CCCCAAGAAAGGGACTGCTGCTCTGGGCAAAGCCAACAGACAGGTGTCCATTACTGGCTTCTTCCAGAGG
AAATAAACTGCCATCTCTGGTAGATCAGAGACTTGGAGTGGTCAAGGGAGAAGACCAAGAAATGTACTCC
TCACTTACTATGTAAGTTCATCTAGATCTCCACCTCACCTGTATCAAAAGACTGTTCTTTCATCCTGTGA
GGTTTATACTATTTCTGGTTTTTAACCAAAAGGAAATCATCTGGAAGCAGGAGGCAAAAAGCTGTTACCT
TCTAATGACATTTAAAAAGCACAGTCTTTGACCTGTCCAGGAGAAGGATTTACTCCAAAATTATACTGGA
ACAGTTTTCAGAATTCTCACTGAAGCCATTTAGTGGCTAACCCACTGTGCTCCACTCACCCTATGCCCTG
GTCCGCATATGGCACAGGAATTATTCCTTCTTGTTCCTCTGTATTCTAAGAATTCATGTGGGTGTTTCTT
ATCCTTACATTCTGCTGGATACGTTTACCCCTCTTGTCTTCCTGCAGTACCACACTTCTGTCCCCTAACC
TCCTGAGGCTGTTCTCTGTAAGTCTTTTAAGTTTTGGTTGGACTAAAGGCTGAAGTGAAAATCTCCCTGT
AATCCTCTTCCTCCATTATGCAGTACACGGACACCTGGCTACAGACCAGGACGTGGCTTGTGTTCTGTTC
CTTTCACAAAAGCTCTCTGGGACCTTCACTTGCAATTAGTGGTTAGGGAAAAGCCTCAGGCAGAACACAA
ATAGAAATTTAATGATGTGTTCAACTCCACCAGAAATTACCTCGAGTCAGCATTGACGATATTGGAGGAG
CTGCCGTGCTGCTGATACGGGGTGTGCTTTATGCTGCTCTTTGCGGTTTGTTGATCCCCTCCTCCCCCAC
TCTCAATACCTAGAGAGTGAAACCCGTACAATGAGATAAAGACTAAAAAGAGAAATCCCTTCCTATATAC
AGTGTGCTACATTTACAAAAAATTTCTCCTTAAGAAAACAGAATATTCAAAAACAGCACTTTTCCAGGAA
GTTAGTGAGGAAGATAAGGCACACATTTATTTATAAATGGATGTTGCTCCTTTGTATTTTTAGCTTCCCT
ATTTGCTTAAAAGTACAGGCTCCCTAAGAGAGGATGGAGAGGGAGAGACTGAATTGTTAGTAGGTCTAAA
CATCAAAGAAAACATTTTTATTAGTTACTTATGGAAAATCATCTATTACAATGATAACCTTCAAGTGACT
TCCATTATGGCTGGACAGGCGGTGAGCTCAGTGGATTGCAGTGGTGTGCTGGTGATTTTGCACAGTGAGC
TCTGCGGAAGGGTCAGGCTCAACTGCTGATGTGTCTCACACGTAGCAGACAAGGGGTGTCTGACTGGCT
TCTTTTGCCTCAAGATGGTGTATGTCGTAAGTGATGCAATCAGCTGTCTGCTTTTTAAGGTTGGGATTGT
GCTGACTTTGGGATTAACATGAGCTTCTTTAGCAACCAAGCATGAACTTGATTAAGACCAGAAGTTTGGG
AGATGAGTCCTGGCATTATGTCTAGGACTAAAGCAGTGGCTTTGTATAGCAAGCTGAGTAAAGGTTGACA
TATTCCAAAACCCTTCTTTTTAAAATGAAAAAGGATGGAGAGAAGGATGGAAAGCCTGGACTTAAACCTT
TAGAAAAAACTTCTGGAGAGAAATCCCTTTTAAACAGTTACTTTTGTCATTGCCTCTGGTCATTTGTCTA
AATAGGAATGGAAAATTAAAAGAAAAGCAACAATCCAATCTTTTTTCTAAAAATTATGCTGGGTCTCGA
CTAAAACTGAATTTGAATTGGAAAATTCTGGTGTTGGTTGGAGTTCCATCTTGCAAGGGATAATACAAAT
CCTATGATCTCTATGCCCAATATGCTGCCTCAACTCTGAGCTGTCTGCAAGGCTTAGTAAGTATTGAGTG
GTGTTTTTTTTTCTTTTTATACAATACCATGTTAACCACATGAGTTAAATAAATTTGAGAAGTTGTTTT
```

Figure 20 (Continued)

>gi|94681044|ref|NM_006685.3| Homo sapiens submaxillary gland androgen regulated
protein 3B (SMR3B), mRNA
GCCAACAGAAATCCATTACAATATATAAGAGCTAAGATTTCTTGTCCCTTTTCACCTTTATTTGCCGTCT
TTCAACTGGCAAGAGTCATTTTGACCAGCAGATTAATCAACTGTAAGACAGATCCTCACACAAAGAGGCA
ACTGAAAGGATGAAATCACTGACTTGGATCTTGGGCCTTTGGGCTCTTGCAGCGTGTTTCACACCTGGTG
AGAGTCAAAGAGGCCCCAGGGGACCATATCCACCTGGACCGCTGGCTCCTCCTCAACCTTTTGGCCCAGG
ATTTGTTCCACCACCTCCTCCTCCACCCTATGGTCCAGGGAGAATCCCACCTCCTCCTCCCGCACCCTAT
GGTCCAGGGATATTTCCACCACCCCCTCCTCAACCCTAAGGTCCACCACTCCATCCTGATGCCCCAGGTT
ATCCACAGCCTCCTTCCCGACCAAGACCCTATCCACCTGGACCTCCATTTTTCCCTGTAAATTCTCCAAC
TGATCCTACCCTCCCTACTCCTGCACCCCAAATATGAACAACTGCAGCAGGTGCCACCACCACCACAAA
GACACCACTACCCTTGTAACTACTGCTTCTACTACCCAAAATATGAATTCCAACACTGCTTCCAAGAGAC
ATTTACATAAAATTGCTTCCATTTTTGGATGAGAATGAAAAATTCCAAAAGTGCTGAGCTTTGGGGAGAA
ATAATCTTAGAAAGAAATTGTAGAAAAAACCCATGCAGACATAACATTTATACCAATGAGGCAAAAATAA
AGAATTGAGCACCAAAAAAAAAAAAAAA >gi|201861792|ref|NM_006832.2| Homo sapiens fermitin family member 2 (FERMT2),
transcript variant 1, mRNA
GGGTGGAGCGCGGGGAGCCAGGCGAGGGGCCGCGACGACGGGACTCCATTAGCCGCTCCGGCCACAGGCA
GCGCTTCGCCAGCCGAGGAACCGGACGCGGACACCGCCGCCCCGCGAGCCTCCAGCCCCTCGCCTGTTGC
CGCGCGAGTCCCGGGCCCGGAGCGCTAGGAGCGCGCGGAAGGAGCCATGGCTCTGGACGGGATAAGGATG
CCAGATGGCTGCTACGCGGACGGGACGTGGGAACTGAGTGTCCATGTGACGGACCTGAACCGCGATGTCA
CCCTGAGAGTGACCGGCGAGGTGCACATTGGAGGCGTGATGCTTAAGCTGGTGGAGAAACTCGATGTAAA
AAAAGATTGGTCTGACCATGCTCTCTGGTGGGAAAAGAAGAGAACTTGGCTTCTGAAGACACATTGGACC
TTAGATAAGTATGGTATTCAGGCAGATGCTAAGCTTCAGTTCACCCCTCAGCACAAACTGCTCCGCCTGC
AGCTTCCCAACATGAAGTATGTGAAGGTGAAAGTGAATTTCTCTGATAGAGTCTTCAAAGCTGTTTCTGA
CATCTGTAAGACTTTTAATATCAGACACCCCGAAGAACTTTCTCTCTTAAAGAAACCCAGAGATCCAACA
AAGAAAAAAAAGAAGAAGCTAGATGACCAGTCTGAAGATGAGGCACTTGAATTAGAGGGGCCTCTTATCA
CTCCTGGATCAGGAAGTATATATTCAAGCCCAGGACTGTATAGTAAAACAATGACCCCACTTATGATGC
TCATGATGGAAGCCCCTTGTCACCAACTTCTGCTTGGTTTGGTGACAGTGCTTTGTCAGAAGGCAATCCT
GGTATACTTGCTGTCAGTCAACCAATCACGTCACCAGAAATCTTGGCAAAAATGTTCAAGCCTCAAGCTC
TTCTTGATAAAGCAAAAATCAACCAAGGATGGCTTGATTCCTCAAGATCTCTCATGGAACAAGATGTGAA
GGAAAATGAGGCCTTGCTGCTCCGATTCAAGTATTACAGCTTTTTTGATTTGAATCCAAAGTATGATGCA
ATCAGAATCAATCAGCTTTACGAGCAGGCCAAATGGGCCATTCTCCTGGAAGAGATTGAATGCACAGAAG
AAGAAATGATGATGTTTGCAGCCCTGCAGTATCATATCAATAAGCTGTCAATCATGACATCAGAGAATCA
TTTGAACAACAGTGACAAAGAAGTTGATGAAGTTGATGCTGCCCTTTCAGACCTGGAGATTACTCTGGAA
GGGGGTAAAACGTCAACAATTTTGGGTGACATTACTTCCATTCCTGAACTTGCTGACTACATTAAAGTTT
TCAAGCCAAAAAAGCTGACTCTGAAAGGTTACAAACAATATTGGTGCACCTTCAAAGACACATCCATTTC
TTGTTATAAGAGCAAAGAAGAATCCAGTGGCACACCAGCTCATCAGATGAACCTCAGGGGATGTGAAGTT
ACCCCAGATGTAAACATTTCAGGCCAAAAATTTAACATTAAACTCCTGATTCCAGTTGCAGAAGGCATGA
ATGAAATCTGGCTTCGTTGTGACAATGAAAAACAGTATGCACACTGGATGGCAGCCTGCAGATTAGCCTC
CAAAGGCAAGACCATGGCGGACAGTTCTTACAACTTAGAAGTTCAGAATATTCTTTCCTTTCTGAAGATG
CAGCATTTAAACCCAGATCCTCAGTTAATACCAGAGCAGATCACGACTGATATAACTCCTGAATGTTTGG

Figure 20 (Continued)

```
TGTCTCCCCGCTATCTAAAAAAGTATAAGAACAAGCAGATAACAGCGAGAATCTTGGAGGCCCATCAGAA
TGTAGCTCAGATGAGTCTAATTGAAGCCAAGATGAGATTTATTCAAGCTTGGCAGTCACTACCTGAATTT
GGCATCACTCACTTCATTGCAAGGTTCCAAGGGGGCAAAAAAGAAGAACTTATTGGAATTGCATACAACA
GACTGATTCGGATGGATGCCAGCACTGGAGATGCAATTAAAACATGGCGTTTCAGCAACATGAAACAGTG
GAATGTCAACTGGGAAATCAAATGGTCACCGTAGAGTTTGCAGATGAAGTACGATTGTCCTTCATTTGT
ACTGAAGTAGATTGCAAAGTGGTTCATGAATTCATTGGTGGCTACATATTTCTCTCAACACGTGCAAAAG
ACCAAAACGAGAGTTTAGATGAAGAGATGTTCTACAAACTTACCAGTGGTTGGGTGTGAATAGGAATACT
GTTTAATGAAACTCCACGGCCATAACAATATTTAACTTTAAAAGCTGTTTGTTATATGCTGCTTAATAAA
GTAAGCTTGAAATTTATCATTTTATCATGAAAACTTCTTTGCCTTACCAGACCAGTTAATATGTGCACTA
AACAAGCACGACTATTAATCTATCATGTTATGATATAATAAACTTGAATTTGTCACACATTCCTTAGGGC
CATGAATTGAAAACTGAAATAGTGGGCAAATCAGGAACAAACCATCACTGATTTACTGATTTAAGCTAGC
CAAACTGTAAGAAACAAGCCATCTATTTTAAAGCTATCCAGGGCTTAACCTATATGAACTCTATTTATCA
TGTCTAATGCATGTGATTTAATGTATGTTTAATTTGATATCATGTTTTAAAATATCCTACTTCTGGTAGC
CATTTAATTCCTCCCCCTACCCCCAAATAAATCAGGCATGCAGGAGGCCTGATATTTAGTAATGTCATTG
TGTTTGACCTTGAAGGAAAATGCTATTAGTCCGTCGTGCTTGATTTGTTTTTGTCCTTGAATAAGCATGT
TATGTATATTGTCTCGTGTTTTTATTTTTACACCATATTGTATTACACTTTTAGTATTCACCAGCATAAT
CACTGTCTGCCTAAAATATGCAACTCTTTGCATTACAATATGAAGTAAAGTTCTATGAAGTATGCATTTT
GTGTAACTAATGTAAAAACACAAATTTTATAAAATTGTACAGTTTTTAAAAACTACTCACAACTAGCAG
ATGGCTTAAATGTAGCAATCTCTGCGTTAATTAAATGCCTTTAAGAGATATAATTAACGTGCAGTTTTAA
TATCTACTAAATTAAGAATGACTTCATTATGATCATGATTTGCCACAATGTCCTTAACTCTAATGCCTGG
ACTGGCCATGTTCTAGTCTGTTGCGCTGTTACAATCTGTATTGGTGCTAGTCAGAAAATTCCTAGCTCAC
ATAGCCCAAAAGGGTGCGAGGGAGAGGTGGATTACCAGTATTGTTCAATAATCCATGGTTCAAAGACTGT
ATAAATGCATTTTATTTTAAATAAAAGCAAAACTTTTATTTAATAAAAAAAAAAAAAAAAA

>gi|58530846|ref|NM_006870.3| Homo sapiens destrin (actin depolymerizing factor)
(DSTN), transcript variant 1, mRNA
GGGAAGCTCCCCTCCGAGACTCTGGATAGCCGCCGGGGGGCGTTGCCTGGCCGGCTGGTTGCGTAGCAA
CGGCAGGCGGTGCGTGACGTGCGCAGCCGCGTTCCGTCCTGAGGCGCGCCCGCCCCGGGGTAAGCTCGCG
CCGCCGCGTCAGCTCAGCGCTGGGTCTCTCGGTCCCGCAGCCGTGAGGAGGACGGTCTGCATACTCGCTG
CCCGCCGGCTCCCTCCCCCGCGTCCCTGCGACCGCCGCGGCGAAGATGGCCTCAGGAGTGCAAGTAGCTG
ATGAAGTATGTCGCATTTTTTATGACATGAAAGTTCGTAAATGCTCCACACCAGAAGAAATCAAGAAAAG
AAAGAAGGCTGTCATTTTTTGTCTCAGTGCAGACAAAAAGTGCATCATTGTAGAAGAAGGCAAAGAGATC
TTGGTTGGAGATGTTGGTGTAACCATAACTGATCCTTTCAAGCATTTTGTGGGAATGCTTCCTGAAAAAG
ATTGTCGCTATGCTTTGTATGATGCAAGCTTTGAAACAAAAGAATCCAGAAAAGAAGAGTTGATGTTTTT
TTTGTGGGCACCAGAACTAGCACCTCTGAAAAGTAAAATGATCTATGCAAGCTCCAAGGATGCAATTAAA
AAGAAATTTCAAGGCATAAAACATGAATGTCAAGCAAATGGACCAGAAGATCTCAATCGGGCTTGTATTG
CTGAAAAGTTAGGTGGATCCTTAATTGTAGCCTTTGAAGGATGCCCTGTGTAGATTATTCAGTGCCACAA
ATTGAAAGCTTCCATGTTTAATGTTATCCTCTTGCTATATAAATAAAGCAAATATATTTAGGCCAGGGTC
TCACTGAGGGGGAGCTGTCTTGTCATCTTTTAGAGTAAACTATTCTATAAACATATGCAAACAGCCCTAA
ATAAATCTAAAGTCTAAAGTTTTATTGATGTGAAATTAAATTCTTATTGGCCAAATGCCTGTTTTGATGA
GTTGATTTATAAAGATTTTGTTAAGCTCAGGATTTTAAATTACACAGTTCACAAACAGTAAAGGCCATG
TGAAGAGAATTATTACATCTTTATTAACCTCAGCATTTACTTTGTTTCTTTTGCTTAGGAAATTGCTCAT
```

Figure 20 (Continued)

```
AATCTGGTTATAATTTTGGTCCAAATTCTTTATTCTTCCTTGAGCTAAGCAGAATAATGGAATATAATAT
GTCTTCATAATATAACAACACTAATACACTAATAGTAAGATTAAGTTAGGCAGTCTTCTACCAAATGTGT
AATGGAGATTGCCTCAAAATTGTGTCCACATAATCCACGCTCATCTTGCAAAGCGCTATTTCAGGCACAT
CATTGGAATACAGGAAGTAGCCCTGCACCTGCCAGTGAGCTCGCCATTCACTGATTGGAAGAGTGACCTG
GCATCTTGGAAATCATTGTGTGTCTTCAGGAGAATGTGCAGTGTCTTGTAACAACTAATTATAATGCAAA
TTAGGGCTACATTGTAATCTGCTTTGTTAATGAAAATGATAAAACAGAATATTGACAAGCTAGGACACCT
GTGGTATCTTTAATTGTATCTCCTTCAGAAGTTTGCTTCTTATGGTATAATAAAGTATGGAAGAATATTG
AGTA

>gi|56699461|ref|NM_006902.3| Homo sapiens paired related homeobox 1 (PRRX1),
transcript variant pmx-1a, mRNA
TGATTCGAGCGGGAAGAGGGGGGTGGGTGGGATCGGTGGGGGAGACCATGACCTCCAGCTACGGGCACGT
TCTGGAGCGGCAACCGGCGCTGGGCGGCCGCTTGGACAGCCCGGGCAACCTCGACACCCTGCAGGCGAAA
AAGAACTTCTCCGTCAGTCACCTGCTAGACCTGGAGGAAGCCGGGGACATGGTGGCGGCACAGGCGGATG
AGAACGTGGGCGAGGCTGGCCGGAGCCTGCTGGAGTCGCCGGGACTCACCAGCGGCAGCGACACCCCGCA
GCAGGACAATGACCAGCTGAACTCAGAAGAAAAAAAGAAGAGAAAGCAGCGAAGGAATAGGACAACCTTC
AATAGCAGCCAGCTGCAGGCTTTGGAGCGTGTCTTTGAGCGGACACACTATCCTGATGCTTTTGTGCGAG
AAGACCTTGCCCGCCGGGTGAACCTCACCGAGGCGAGAGTGCAGGTGTGGTTTCAGAACCGAAGAGCCAA
GTTCCGCAGGAATGAGAGAGCCATGCTAGCCAATAAAAACGCTTCCCTCCTCAAATCCTACTCAGGAGAC
GTGACTGCTGTGGAGCAGCCCATCGTACCTCGTCCTGCTCCGAGACCCACCGATTATCTCTCCTGGGGGA
CAGCGTCTCCGTACAGATCCTCGTCCCTCCCAAGATGTTGTTTACACGAGGGGCTTCATAACGGATTCTA
ACGGAAGACACTGAAAAGCGCCATGGCTACTTATTCTGCCACATGTGCCAACAATAGCCCTGCACAGGGC
ATCAACATGGCCAACAGCATTGCCAACCTGAGACTGAAGGCCAAGGAATATAGTTTACAGAGGAACCAGG
TGCCAACAGTCAACTGAGGAAAAAAAATAATTAAACAGGCCTAAGAAGAAATCAAAAACCATAAGACACC
TATCCTGCTCTGTTATTTCTTCATCTGCTGGGGGGAAAAAGTAAATTACAAACAAACAAACAAAGCAGAA
CTAAAATATTGGGACCATGGCAGAGAAAAGCAGGAGAGGAGCAAAATGAAAATTAGTTAACAAATGTTCC
TCCTCCCTCTGGGATACCACCACCACTTGTTTCTGTGTGTGTTTATTTTGTTTTTCTTTCATTCATGCTT
TGCTTAATGTACTCCAGGCTTCTTCAGATAGGTTCAGCCCACCCACCCCCATGATTGTATGAAGTTTTAA
AAAAAACTACAGCAGCCAAAGAAACTATATATATATATATATATATATATATATCCAGAATGATTGCCTCTA
CTGTCCTCATTGACTTGTTTGAACCTTAGTGCCTTACCCTGTCCTCTTCCCAGTTCTCTTTATAGAAGCT
CTAGGAGCTTTCGAAAAGCCAAAGTCTTTCTGAAGAATCTGTGCTGGACAGACATAATTCCCTTTCTCAT
TGTCTCCATCTTTGTTGGTCATGGTAAGGTTTTTCCATCAGCCTCTGAAAAAATAGTTGTGCACAACATC
TGCTCACTGGACTGTCTGATCCAATGTAATTGGCTGCGTCTGGCTAATTCTAAGCACTAAAGTCTACATC
TAAGCTATAGATTTAAGCTTGAAGCTACAGATTATATCACTATCACCACCACCCCTCACCCTATGCAATC
AATCAATCAATCATCTTAAGTTAAAGATATTTGTTGTCTTTGAATGATTTGCTGTCACAGACTATTTGGT
AGAAGAAATATTTTTCACCTGAGAGAGGAAGAGAAATTTCTCTAGTAACACAAAGAGTGAGTTCTAAAAG
GCATGCCACATCTCTTTCGTGCCTTAAGGATAGTGAGATGCACACTTATATATATACTGTATATATTTA
TATATTTATATATATATTTCATATATATATATAATATTGCAAGCTTAAGTTTGCAATTTCCCAAACAATA
CAAAAAGCAAATTACACACCCTCACCACTGTTCTTATCTCTATAGTGATGAAACATTAATTAGGGATCTT
GCTGCTTTTCTTTTTCTACACGAAGTTTTCATTAAAGCCACAGAATAATTGATAGGGCAGCTGTTTGAGA
ACAGGTCCCATTTTCACATTAGGGCTTTAAATGAATTAGAAACTATTTGAGGCTATAAAAATGTCCTTGA
GTTTGGAGCCTGAGCTCTGGTGAAATGCTGATACATCTGATCTATCATGGGAATTGCAGTTAGAGAGAGT
```

Figure 20 (Continued)

```
AAGGAATACCATTTAGTCATCTATCCGTTCTTCACTTAGCAGGAATATGAAAGAAAGGCACATGTTTAAG
AGGAATACCTAAAGGTTTTTCTAAATTCCAACATTTAAAAGGCAATTGTGGGCTATTTTTATTTTTAAT
ATTTTGAAATAAAGTTTAGTGTCTAGGGCTGGGAGCCAGGACTGATCTTCCATTTCTTTTTCTTTGTTCC
CAGCCATGCTTTTGTAACTTGCCAGGTGGACTTGACCAACTACATTACCATGCTGTGCCTCAGTTTACCC
ATTTGTAAAATGGGATTAATAATACTTACCTACCTCACAGGGGTGTTGTGAGGCTCTATTCATTTGCTCC
TTTATTCTTTCCTGTATTCTCTGTATGTCCAGCACTTTGTAGCCATGGGAGGAAAGGGACTATAAAAGTG
TACAATGTTAATGGAATGATACGGTACCTGAAAGCCTTGTTTTCTAGTAAGAAAATGCTACCTTGCTGTA
CATACTTATAACCTTGTATTTGGAAATGAGAAATAGGTTTATATTTTCAGATCTCTCAAAAATCACATCA
TTTGACCAAAGAATAATTTAAGACACATAGAACAGATTTTTTAATTTATATTTTCATCCTGACCAGCTT
AGTTCTAATAATTTTTAGTTGTGAGTGATTAAAAAACTTTGGATCAATTTTGGTCAAACATGCCAACTTT
GTAGTCTGAGTGACAGGCAAGGATTTTTGGGTTTAAGATGCACTTTTAGCACACATTTGTATTTCCCTTG
GCATATCAGATTGAGCTAATGGTGATGTTATTTCAATCTAACAGCCACCAATCTGAAATTGTATTTCAAA
TGTTGATTCTGTAGTTCTTTAAATAATAATGAAGCTCATCTTATACATTTTGCTTTCACCAATTGATTCC
TTCTTCTTTTAGCCCACTATTAAAACATTTCTTACTGAATGGTTCATGTAGGCTTGCTGAACAGCACGCA
TTACTTGCTTCCTGAAGAGTTCCCCCATTCATCCATTTGTCCCATTAGTTGCTGTGGATTATCAAGTTTT
GAAGGAACTGTACATCCCAACAGACTGAAACATTCTAAGTGAAATGAGTATAATCCAAGTAACTGGTGAA
CTTTGGAGGTTTGGAGCTTGAAGAGAATGGCTAAGAAGATTTGAATTATAGGGAGGGAACAGAAATCATA
CATGAAAAGGTTTTACTGAGAAGGGGAAAACCTTAGATAGAGGGACATGTGAAACAAAATCATTTGAAAT
TTTGATTCAGACATCCATTTCCAGTGGCAAACAGCAAAGCCTGAACCCATAAACCCAAATGATAGGTGAA
GTTGGGTGGTTTTATCCAATGTCTCAAGCAAGCAATGTCTGGGAATATCATAGAGTAACAAGTGCTGGTC
AGCCAAAGAAACATTCACTGCTGGTGAACCAATACCATAAGCATGTATTATCTAAGCACTTGATCAAGAA
ATATACATGTTGTACAAGCTCTCAATTTTGTTCATTTATTATCAAATTTTTAAAATACAAGTTTGGTATG
TGATTTGGAAAAGATGCCTTCTGGATCTTAAGCCAGTTGTCAGTGGAGGTCCTCAGGGCTGCAAATGTCA
AGACATAACCCTGTTCCTCACCATCATGATACCAGATACAGGTGAATACATAGGAACTATCTGCCTGTGT
CCTCAATCTCCCTTCAAACAAGATGCTGATTTGTAGGGTACTTGGCAGGTTAAATTAAACCAGAAGAGGT
GACTTAATAAAAAAGGGAATGACATTTAGGGTATAAAGATCTCATAAGAAATGTAATATGTAAATTATAT
CTTGCTTTATGTTGTAAAATATACATTGTTTGCGCTAGAATAGAAATGATTTCTTTTCAATAAAAAGAAA
GAAGGACTCTA

>gi|47519538|ref|NM_007008.2| Homo sapiens reticulon 4 (RTN4), transcript variant
3, mRNA
AGCCTAGTTACAGATTGCACTGCGTCAGACTGTTCCACACCCAGAAGACGTCAGGTGACTTCAGTCCTGC
TGCAGTTGTGCAGCAGAGGAGACTGCAGACTTCGGTTGAGGAAACGGGTATTTCATGTCTCAGGGAGTAG
GTTTGTGCAGTTACAGCTTTTCTGTTGGTATGCATAATTAATAATTGGAGCTGCAAAGCAGATCGTGACA
AGAGATGGACGGTCAGAAGAAAAATTGGAAGGACAAGGTTGTTGACCTCCTGTACTGGAGAGACATTAAG
AAGACTGGAGTGGTGTTTGGTGCCAGCCTATTCCTGCTGCTTTCATTGACAGTATTCAGCATTGTGAGCG
TAACAGCCTACATTGCCTTGGCCCTGCTCTCTGTGACCATCAGCTTTAGGATATACAAGGGTGTGATCCA
AGCTATCCAGAAATCAGATGAAGGCCACCCATTCAGGGCATATCTGGAATCTGAAGTTGCTATATCTGAG
GAGTTGGTTCAGAAGTACAGTAATTCTGCTCTTGGTCATGTGAACTGCACGATAAAGGAACTCAGGCGCC
TCTTCTTAGTTGATGATTTAGTTGATTCTCTGAAGTTTGCAGTGTTGATGTGGGTATTTACCTATGTTGG
TGCCTTGTTTAATGGTCTGACACTACTGATTTTGGCTCTCATTTCACTCTTCAGTGTTCCTGTTATTTAT
GAACGGCATCAGGCACAGATAGATCATTATCTAGGACTTGCAAATAAGAATGTTAAAGATGCTATGGCTA
```

Figure 20 (Continued)

```
AAATCCAAGCAAAAATCCCTGGATTGAAGCGCAAAGCTGAATGAAAACGCCCAAAATAATTAGTAGGAGT
TCATCTTTAAAGGGGATATTCATTTGATTATACGGGGAGGGTCAGGGAAGAACGAACCTTGACGTTGCA
GTGCAGTTTCACAGATCGTTGTTAGATCTTTATTTTTAGCCATGCACTGTTGTGAGGAAAAATTACCTGT
CTTGACTGCCATGTGTTCATCATCTTAAGTATTGTAAGCTGCTATGTATGGATTTAAACCGTAATCATAT
CTTTTTCCTATCTATCTGAGGCACTGGTGGAATAAAAAACCTGTATATTTTACTTTGTTGCAGATAGTCT
TGCCGCATCTTGGCAAGTTGCAGAGATGGTGGAGCTAGAAAAAAAAAAAAAAAAGCCCTTTTCAGTTTGT
GCACTGTGTATGGTCCGTGTAGATTGATGCAGATTTTCTGAAATGAAATGTTTGTTTAGACGAGATCATA
CCGGTAAAGCAGGAATGACAAAGCTTGCTTTTCTGGTATGTTCTAGGTGTATTGTGACTTTTACTGTTAT
ATTAATTGCCAATATAAGTAAATATAGATTATATATGTATAGTGTTTCACAAAGCTTAGACCTTTACCTT
CCAGCCACCCCACAGTGCTTGATATTTCAGAGTCAGTCATTGGTTATACATGTGTAGTTCCAAAGCACAT
AAGCTAGAAGAAGAAATATTTCTAGGAGCACTACCATCTGTTTTCAACATGAAATGCCACACACATAGAA
CTCCAACATCAATTTCATTGCACAGACTGACTGTAGTTAATTTTGTCACAGAATCTATGGACTGAATCTA
ATGCTTCCAAAAATGTTGTTTGTTTGCAAATATCAAACATTGTTATGCAAGAAATTATTAATTACAAAAT
GAAGATTTATACCATTGTGGTTTAAGCTGTACTGAACTAAATCTGTGGAATGCATTGTGAACTGTAAAAG
CAAAGTATCAATAAAGCTTATAGACTTAAAAAAAAAAAAAAAAAAAAAAAAAAAAAA

>gi|32967292|ref|NM_007019.2| Homo sapiens ubiquitin-conjugating enzyme E2C
(UBE2C), transcript variant 1, mRNA
AAACGCGGGCGGGCGGGCCCGCAGTCCTGCAGTTGCAGTCGTGTTCTCCGAGTTCCTGTCTCTCTGCCAA
CGCCGCCCGGATGGCTTCCCAAAACCGCGACCCAGCCGCCACTAGCGTCGCCGCCGCCCGTAAAGGAGCT
GAGCCGAGCGGGGCGCCGCCCGGGGTCCGGTGGGCAAAAGGCTACAGCAGGAGCTGATGACCCTCATGA
TGTCTGGCGATAAAGGGATTTCTGCCTTCCCTGAATCAGACAACCTTTTCAAATGGGTAGGGACCATCCA
TGGAGCAGCTGGAACAGTATATGAAGACCTGAGGTATAAGCTCTCGCTAGAGTTCCCCAGTGGCTACCCT
TACAATGCGCCCACAGTGAAGTTCCTCACGCCCTGCTATCACCCAACGTGGACACCCAGGGTAACATAT
GCCTGGACATCCTGAAGGAAAAGTGGTCTGCCCTGTATGATGTCAGGACCATTCTGCTCTCCATCCAGAG
CCTTCTAGGAGAACCCAACATTGATAGTCCCTTGAACACACATGCTGCCGAGCTCTGGAAAAACCCCACA
GCTTTTAAGAAGTACCTGCAAGAAACCTACTCAAAGCAGGTCACCAGCCAGGAGCCCTGACCCAGGCTGC
CCAGCCTGTCCTTGTGTCGTCTTTTTAATTTTTCCTTAGATGGTCTGTCCTTTTTGTGATTTCTGTATAG
GACTCTTTATCTTGAGCTGTGGTATTTTTGTTTTGTTTTTGTCTTTTAAATTAAGCCTCGGTTGAGCCCT
TGTATATTAAATAAATGCATTTTTGTCCTTTTTAGACAAAAAAAAAAAAAAAA >gi|36287087|ref|NM_007045.2| Homo sapiens FGFR1 oncogene partner (FGFR1OP),
transcript variant 1, mRNA
CGGCCGCGTAGCCCGCGCGCGGAGCGTACCCTGCTGCGGCCGTTGGCCGTTAGCGCGGCTTCGGCGGTTG
TCTTGGAGAAGCAAGATGGCGGCGACGGCGGCCGCAGTGGTGGCCGAGGAGGACACGGAGCTGCGGGACC
TGCTGGTGCAGACGCTGGAGAACAGCGGGGTCCTGAACCGCATCAAGGCTGAACTCCGAGCAGCTGTGTT
TTTAGCACTAGAGGAGCAAGAAAAAGTAGAGAACAAAACTCCTTTAGTTAATGAGAGCCTGAAAAAGTTT
TTAAATACCAAAGACGGTCGTTTAGTGGCTAGTCTTGTTGCAGAATTTCTTCAGTTTTTTAACCTTGACT
TTACTTTGGCTGTTTTTCAACCTGAAACTAGCACACTGCAAGGTCTCGAAGGTCGAGAGAATTTAGCCCG
AGATTTAGGTATAATTGAAGCAGAAGGTACTGTGGGTGGACCCTTATTATTAGAAGTGATCAGGCGCTGT
CAACAGAAAGAAAAAGGGCCAACCACTGGGGAAGGTGCACTTGATCTATCTGATGTACATTCTCCACCAA
AGTCACCAGAGGGAAAAACAAGTGCACAGACAACACCAAGTAAGATACCAAGGTATAAAGGACAAGGTAA
```

Figure 20 (Continued)

```
GAAGAAGACAAGCGGGCAGAAGGCTGGTGACAAGAAGGCCAATGATGAGGCCAATCAGAGTGATACAAGT
GTCTCCTTGTCAGAACCCAAGAGCAAAAGCAGCCTTCACTTACTGTCCCATGAAACAAAAATTGGATCTT
TTCTAAGCAACAGAACTTTAGATGGCAAAGACAAAGCTGGCCTTTGTCCAGATGAAGATGATATGGAAGG
AGATTCTTTCTTTGATGATCCCATTCCTAAGCCAGAGAAAACTTACGGTTTGAGGAAGGAACCTAGGAAG
CAAGCAGGAAGTCTGGCCTCGCTCTCGGATGCACCCCCCTTAAAAAGTGGACTCAGCTCCCTGGCGGGAG
CCCCTTCTTTAAAAGACTCTGAGAGTAAAAGGGGAAATACAGTTTTGAAAGATCTGAAATTGATCAGTGA
TAAAATTGGATCACTTGGATTAGGAACTGGAGAAGATGATGACTATGTTGATGATTTTAATAGTACCAGC
CATCGCTCAGAGAAAAGTGAGATAAGTATTGGTGAAGAGATAGAAGAAGACCTTTCTGTGGAAATAGATG
ACATCAATACCAGTGATAAGCTTGATGACCTCACACAAGATCTGACTGTATCCCAGCTCAGTGATGTTGC
GGATTATCTGGAAGATGTTGCATAGACACGAAGAAGGAAGTATTCTAATTAACAAGGACAGAGGACTGAC
CGGTTCCATTTTTTTTTTTCCAGACAATCACTCAGCTGGAATGTCTGCTCTCTATTGGTGCCTTGCATT
TCAAAAACACTGCAGATATTTTTAAAAGTAATTTTCATTTTACTAAACAAAATACTTCCTATTTGAGCC
CATGTGTGGAAGATTTAATATTCTTAATTTAACTGTACATTTCTTTATGGAAATTGATTATCTACACTCA
GTTTCATTACAGGGAAGGAACCCATGAAAACATCAGTGTTAAGAGCATGATGAAAGGTGTCAATAAAGCC
GTAGGATCGCGCAACCCTTTGTGTGTGGCTGCTGGTACGTGTGATCTTTGAAAACCTTGGCTTTAGCC
CTCTGGAATCAGAGCTTACCCACCATAGTATATTTTGATATTAGGTGGTTCTACACATAGTTGGCAAAAT
GACTTGGTAAATTTGTAATGCTGAAGTATATTAGTATAAGTTAAATTTGATGTGTCAACTTTATTTTGTA
TTTCCTTCCATTTGGAAGGTTTGTTAGACCATTAAGGTTATATTAAAGTACTCTTGTGTGTGCTAAAAAA
AAAAAAAAAAAA

>gi|122056696|ref|NM_007173.4| Homo sapiens protease, serine, 23 (PRSS23), mRNA
GCGGCTTCCCCGAGGCCGGAGGCGGGGCGGGCGGGCCTCGGGTGGCGCGGGGGGCGGACCCGCCAGCTGC
CTGCGCTGCTCGCCAGCTTGCTCGCACTCGGCTGTGCGGCGGGGCAGGCATGGGAGCCGCGCGCTCTCTC
CCGGCGCCCACACCTGTCTGAGCGGCGCAGCGAGCCGCGGCCCGGGCGGGCTGCTCGGCGCGGAACAGTG
CTCGGCATGGCAGGGATTCCAGGGCTCCTCTTCCTTCTCTTCTTTCTGCTCTGTGCTGTTGGGCAAGTGA
GCCCTTACAGTGCCCCCTGGAAACCCACTTGGCCTGCATACCGCCTCCCTGTCGTCTTGCCCCAGTCTAC
CCTCAATTTAGCCAAGCCAGACTTTGGAGCCGAAGCCAAATTAGAAGTATCTTCTTCATGTGGACCCCAG
TGTCATAAGGGAACTCCACTGCCCACTTACGAAGAGGCCAAGCAATATCTGTCTTATGAAACGCTCTATG
CCAATGGCAGCCGCACAGAGACGCAGGTGGGCATCTACATCCTCAGCAGTAGTGGAGATGGGCCCAACA
CCGAGACTCAGGGTCTTCAGGAAAGTCTCGAAGGAAGCGGCAGATTTATGGCTATGACAGCAGGTTCAGC
ATTTTTGGGAAGGACTTCCTGCTCAACTACCCTTTCTCAACATCAGTGAAGTTATCCACGGGCTGCACCG
GCACCCTGGTGGCAGAGAAGCATGTCCTCACAGCTGCCCACTGCATACACGATGGAAAAACCTATGTGAA
AGGAACCCAGAAGCTTCGAGTGGGCTTCCTAAAGCCCAAGTTTAAAGATGGTGGTCGAGGGCCAACGAC
TCCACTTCAGCCATGCCCGAGCAGATGAAATTTCAGTGGATCCGGGTGAAACGCACCCATGTGCCCAAGG
GTTGGATCAAGGGCAATGCCAATGACATCGGCATGGATTATGATTATGCCCTCCTGGAACTCAAAAAGCC
CCACAAGAGAAAATTTATGAAGATTGGGGTGAGCCCTCCTGCTAAGCAGCTGCCAGGGGCAGAATTCAC
TTCTCTGGTTATGACAATGACCGACCAGGCAATTTGGTGTATCGCTTCTGTGACGTCAAAGACGAGACCT
ATGACTTGCTCTACCAGCAATGCGATGCCCAGCCAGGGGCCAGCGGGTCTGGGGTCTATGTGAGGATGTG
GAAGAGACAGCAGCAGAAGTGGGAGCGAAAAATTATTGGCATTTTTCAGGGCACCAGTGGGTGGACATG
AATGGTTCCCCACAGGATTTCAACGTGGCTGTCAGAATCACTCCTCTCAAATATGCCCAGATTTGCTATT
GGATTAAAGGAAACTACCTGGATTGTAGGGAGGGGTGACACAGTGTTCCCTCCTGGCAGCAATTAAGGGT
CTTCATGTTCTTATTTTAGGAGAGGCCAAATTGTTTTTTGTCATTGGCGTGCACACGTGTGTGTGTGTGT
```

Figure 20 (Continued)

```
GTGTGTGTGTGTAAGGTGTCTTATAATCTTTTACCTATTTCTTACAATTGCAAGATGACTGGCTTTACTA
TTTGAAAACTGGTTTGTGTATCATATCATATATCATTTAAGCAGTTTGAAGGCATACTTTTGCATAGAAA
TAAAAAAAATACTGATTTGGGGCAATGAGGAATATTTGACAATTAAGTTAATCTTCACGTTTTTGCAAAC
TTTGATTTTTATTTCATCTGAACTTGTTTCAAAGATTTATATTAAATATTTGGCATACAAGAGATATGAA
TTCTTATATGTGTGCATGTGTGTTTTCTTCTGAGATTCATCTTGGTGGTGGGTTTTTTTGTTTTTTTAAT
TCAGTGCCTGATCTTTAATGCTTCCATAAGGCAGTGTTCCCATTTAGGAACTTTGACAGCATTTGTTAGG
CAGAATATTTTGGATTTGGAGGCATTTGCATGGTAGTCTTTGAACAGTAAATGATGTGTTGACTATACT
GATACACATATTAAACTATACCTTATAGTAAACCAGTATCCCAAGCTGCTTTTAGTTCCAAAAATAGTTT
CTTTTCCAAAGGTTGTTGCTCTACTTTGTAGGAAGTCTTTGCATATGGCCCTCCCAACTTTAAAGTCATA
CCAGAGTGGCCAAGAGTGTTTATCCCAACCCTTCCATTTAACAGGATTTCACTCACATTTCTGGAACTAG
CTATTTTTCAGAAGACAATAATCAGGGCTTAATTAGAACAGGCTGTATTTCCTCCCAGCAAACAGTTGTG
GCCACACTAAAAACAATCATAGCATTTTACCCCTGGATTATAGCACATCTCATGTTTTATCATTTGGATG
GAGTAATTTAAAATGAATTAAATTCCAGAGAACAATGGAAGCATTGCCTGGCAGATGTCACAACAGAATA
ACCACTTGTTTGGAGCCTGGCACAGTCCTCCAGCCTGATCAAAAATTATTCTGCATAGTTTTCAGTGTGC
TTTCTGGGAGCTATGTACTTCTTCAATTTGGAAACTTTTCTCTCTCATTTATAGTGAAAATACTTGGAAG
TTACTTTAAGAAAACCAGTGTGGCCTTTTTCCCTCTAGCTTTAAAAGGGCCGCTTTTGCTGGAATGCTCT
AGGTTATAGATAAACAATTAGGTATAATAGCAAAAATGAAAATTGGAAGAATGCAAAATGGATCAGAATC
ATGCCTTCCAATAAAGGCCTTTACACATGTTTTATCAATATGATTATCAAATCACAGCATATACAGAAAA
GACTTGGACTTATTGTATGTTTTTATTTTATGGCTCTCGGCCTAAGCACTTCTTTCTAAATGTATCGGAG
AAAAAATCAAATGGACTACAAGCACGTGTTTGCTGTGCTTGCACCCCAGGTAAACCTGCATTGTAGCAAT
TTGTAAGGATATTCAGATGGAGCACTGTCACTTAGACATTCTCTGGGGATTTTCTGCTTGTCTTTCTTG
AGCTTTTTGGAAGGATAATTCTGATAAGGCACTCAAGAAACGTACAACCACAGTGCTTTCTTCAAATCAT
ATGAGAAATACTATGCATAGCAAGGAGATGCAGAGCCGCCAGGAAAATTCTGAGTTCCAGCACAATTTTC
TTTGGAATCTAACAGGAATCTAGCCTGAGGAAGAAGGGAGGTCTCCATTTCTATGTCTGGTATTTGGGGG
TTTTGTTTGTTTTTGCTTTAGCTTGGTGAAAAAAAGTTCACTGAACACCAAGACCAGAATGGATTTTTTT
AAAAAAATAGATGTTCCTTTTGTGAAGCACCTTGATTCCTTGATTTTGATTTTTTGCAAAGTTAGACAAT
GGCACAAAGTCAAAATGAAATCAATGTTTAGTTCACAAGTAGATGTAATTTACTAAAGAATGATACACCC
ATATGCTATATACAGCTTAACTCACAGAACTGTAAAAGAAAATTATAAAATAATTCAACATGTCCATCTT
TTTAGTGATAATAAAAGAAAGCATGGTATTAAACTATCATAGAAGTAGACAGAAAAAGAAAAAAGGACTC
ATGGCATTATTAATATAATTAGTGCTTTACATGTGTTAGTTATACATATTAGAAGCATATTTGCCTAGTA
AGGCTAGTAGAACCACATTTCCCAAAGTGTGCTCCTTAAACACTCATGCCTTATGATTTTCTACCAAAAG
TAAAAAGGGTTGTATTAAGTCAGAGGAAGATGCCTCTCCATTTTCCCTCTCTTTATCAGAGGTTCACATG
CCTGTCTGCACATTAAAAGCTCTGGGAAGACCTGTTGTAAAGGGACAAGTTGAGGTTGTAAAATCTGCAT
TTAAATAAACATCTTTGATCACAAAA

>gi|312176372|ref|NM_007256.4| Homo sapiens solute carrier organic anion
transporter family, member 2B1 (SLCO2B1), transcript variant 1, mRNA
AAAAGGACAGGCTGAGGCTGAGCCTCAGGGAGGCGGGGTGCAGCTTCCTCTTCACAGAGAGGCTGGACTT
GAACAAACCCAGCCTTCTATACAACCGTGGAGCCAGGGCAAGGGAGAGACAGAAGGAGCAAGTGACCCAG
GGAGACAAACACTTGGAGATACTTGGGGCTGAGTTTGAGCAAGACTCCCTAACCTGTGTCTGGACAAGTC
TGATGTCCTGTGTGGCCCAAGAAGAACTGACCCCGTGTCTGGAGCTCCACCGTTATTGCATCCCTGCTG
TGGCTCACCTGCTGCTGTCTCCAGGAGCCCCTGAGAAGATTTGCTTCCTCTCCCCTGCTAAGCTCCAGGT
```

Figure 20 (Continued)

```
CCTGAGATTAAATTAGGGGCTGGAGCTCACTGCACTCCAGCAGTCATGGGACCCAGGATAGGGCCAGCGG
GTGAGGTACCCCAGGTACCAGACAAGGAAACCAAAGCCACAATGGGCACAGAAAACACACCTGGAGGCAA
AGCCAGCCCAGACCCTCAGGACGTGCGGCCAAGTGTGTTCCATAACATCAAGCTGTTCGTTCTGTGCCAC
AGCCTGCTGCAGCTGGCGCAGCTCATGATCTCCGGCTACCTAAAGAGCTCCATCTCCACAGTGGAGAAGC
GCTTCGGCCTCTCCAGCCAGACGTCGGGGCTGCTGGCCTCCTTCAACGAGGTGGGGAACACAGCCTTGAT
TGTGTTTGTGAGCTATTTTGGCAGCCGGGTGCACCGACCCCGAATGATTGGCTATGGGGCTATCCTTGTG
GCCCTGGCGGGCCTGCTCATGACTCTCCCGCACTTCATCTCGGAGCCATACCGCTACGACAACACCAGCC
CTGAGGATATGCCACAGGACTTCAAGGCTTCCCTGTGCCTGCCCACAACCTCGGCCCCAGCCTCGGCCCC
CTCCAATGGCAACTGCTCAAGCTACACAGAAACCCAGCATCTGAGTGTGGTGGGGATCATGTTCGTGGCA
CAGACCCTGCTGGGCGTGGGCGGGGTGCCCATTCAGCCCTTTGGCATCTCCTACATCGATGACTTTGCCC
ACAACAGCAACTCGCCCCTCTACCTCGGGATCCTGTTTGCAGTGACCATGATGGGGCCAGGCCTGGCCTT
TGGGCTGGGCAGCCTCATGCTGCGCCTTTATGTGGACATTAACCAGATGCCAGAAGGTGGTATCAGCCTG
ACCATAAAGGACCCCGATGGGTGGGTGCCTGGTGGCTGGGTTTCCTCATCGCTGCCGGTGCAGTGGCCC
TGGCTGCCATCCCCTACTTCTTCTTCCCCAAGGAAATGCCCAAGGAAAAACGTGAGCTTCAGTTTCGGCG
AAAGGTCTTAGCAGTCACAGACTCACCTGCCAGGAAGGGCAAGGACTCTCCCTCTAAGCAGAGCCCTGGG
GAGTCCACGAAGAAGCAGGATGGCCTAGTCCAGATTGCACCAAACCTGACTGTGATCCAGTTCATTAAAG
TCTTCCCCAGGGTGCTGCTGCAGACCCTACGCCACCCCATCTTCCTGCTGGTGGTCCTGTCCCAGGTATG
CTTGTCATCCATGGCTGCGGGCATGGCCACCTTCCTGCCCAAGTTCCTGGAGCGCCAGTTTTCCATCACA
GCCTCCTACGCCAACCTGCTCATCGGCTGCCTCTCCTTCCCTTCGGTCATCGTGGGCATCGTGGTGGGTG
GCGTCCTGGTCAAGCGGCTCCACCTGGGCCCTGTGGGATGCGGTGCCCTTTGCCTGCTGGGGATGCTGCT
GTGCCTCTTCTTCAGCCTGCCGCTCTTCTTTATCGGCTGCTCCAGCCACCAGATTGCGGGCATCACACAC
CAGACCAGTGCCCACCCTGGGCTGGAGCTGTCTCCAAGCTGCATGGAGGCCTGCTCCTGCCCATTGGACG
GCTTTAACCCTGTCTGCGACCCCAGCACTCGTGTGGAATACATCACACCCTGCCACGCAGGCTGCTCAAG
CTGGGTGGTCCAGGATGCTCTGGACAACAGCCAGGTTTTCTACACCAACTGCAGCTGCGTGGTGGAGGGC
AACCCCGTGCTGGCAGGATCCTGCGACTCAACGTGCAGCCATCTGGTGGTGCCCTTCCTGCTCCTGGTCA
GCCTGGGCTCGGCCCTGGCCTGTCTCACCCACACACCCTCCTTCATGCTCATCCTAAGAGGAGTGAAGAA
AGAAGACAAGACTTTGGCTGTGGGCATCCAGTTCATGTTCCTGAGGATTTTGGCCTGGATGCCCAGCCCC
GTGATCCACGGCAGCGCCATCGACACCACCTGTGTGCACTGGGCCCTGAGCTGTGGGCGTCGAGCTGTCT
GTCGCTACTACAATAATGACCTGCTCCGAAACCGGTTCATCGGCCTCCAGTTCTTCTTCAAAACAGGTTC
TGTGATCTGCTTCGCCTTAGTTTTGGCTGTCCTGAGGCAGCAGGACAAAGAGGCAAGGACCAAAGAGAGC
AGATCCAGCCCTGCCGTAGAGCAGCAATTGCTAGTGTCGGGGCCAGGGAAGAAGCCAGAGGATTCCCGAG
TGTGAGCTGTCTTGGGGCCCCACCTGGCCAAGAGTAGCAGCCACAGCAGTACCTCCTCTGAGTCCTTTGC
CCAAGATTGGGTGTCAAGAGCCCTGTGTTCCATTCTGGCTCCTCCACTAAATTGCTGTGTGACTTCAGGC
AAGACATTGATCCTCTCTCAGCCTTTGCTTGCTAGTCTGAACCAAAGAGTTGTTTGGGCATTTGCTGTGT
TGGCCATTTCTGGAGCAAGAGGGTCTTCTTCCTCCTTCCCCAGCCAGCCAGCTGTCCTGGGGCCAGGCT
TTCCTGGGTGGAAAGAAGTATACCTTTCCCTGGGGCCCTAGGATAGCAAAGTGAGCCATAGTGGGCCAGG
CTGCCCTCCATGCTGGGCCCCAGCCCAGGTCTGCACTCGCCTGGATCACCTTCTTTGAGCCTTAGCCATC
TCCTGTCAGGTAGGAATGAACTTGCCAGCCTTCAGGCTCGTTCAGCTATGACCATCTGTGCGGTCAGGGT
ACACTCAGCTCTCCTCCCCAACTCCAGCAGCCTTTAAGAAGTGTCCCTTTGGCGCCCCTGGAGGCAGAG
CACTGAGCTGGACCCTGGGTAGACTCCCACAGGGAGGACGGAGCTGGCCTCAGGAGTGGGACACCCAGAC
TTGGCAGGGCCTTCAAGAGGCCTGTGTGGGGCCCCAGGAATCCTTAGCTGAAGCGGGGAGACTCACTCT
CCATCTCAGGAAATTCTAGCCCTTGCCCTCAGGGAGCCACGGTTGAGGGTGAGGCCCAACACCTGCCTTA
```

Figure 20 (Continued)

```
GGGCCCTGGGTGGGCAAGTCTGGGCCCTGGGGTAGGGAGGGAGACTCAGGCCCACACTTGGGTATTTTCT
AATTTCAGACAAACACACACTCAGCGCGCACTCACTGATTCCTACACATTGCCAAGATTTCACACATGTG
ACCAGGGGCCACCAAAGTCCCTGTGACCTTTGTGACTAGGATCCTAATTTCTCTATTTTCTCCTGGGTGC
CTGGGTCTGTGTCACCTGGGGCAGTGTGGATAATGTTTAGTTCTGTGACACTGTTTTTTGGGGGTGGCAC
CTGGTTCTCCGATGCCTGGGCTGGTGTCAGGCCCAGGACTGTAGTGCTGGGAGCAGTAAAGCTCAGCTCT
GTGTAATGAGTGATGCTATGGCTTGCTCGTGTCTTATGATCCAATCCTTTTCTACATCAGCCCTTGTTTT
GTTTTATGGCTAGTCTTATCTGGCCTGGTTATTTCCTTGCGGGAGGAGAGGGTTTGCTAATCTGCTCCC
AGCCCAACCTATTACCACCCCACCTCGCTGGGACCTACTGCTCGGGAGGCAGCAGACAGGGAGCCACCAG
CAGTGGCTTCCTGGCCCTGTGCTGGGGGTGGGGGAAGCTGGGGGCACATGTGGCCCTTGCCTTCTGAGC
AGCTCCCAGTGCCAGGGCTTTGAGACTTTCCCACATGATAAAAGAAAAGGGAGGTACAGAAGTTCCAATT
CCCTTTTTATTTTGCTGGTTGGTATCTGTAAATGTTTAATAAATATCTGAGCATGTATCTATCAACGCCA
AGAATTTCAAAGTCTCCTTCAACAATATGAGGCTTTTAGGATGTTTATATTCCTTCATCCCTCTTGTTTC
CCAGGTTTTGCAGGGAAAAAAAGTCTGGAATTATAGATACAGCTTATTATTAAATTTGTTCTTGCATAAT
GTCTCTTCTATTACAAAAATTCTTTCTTCATAAACTGCATTAGAGGTTTGCAACAACCACATCATTTCCA
TTAACTTAGATTTAGGTTTTACTGGATTCATTGCTCACCATTATTGCTTGTATATTACATCTTTTCCAAT
CTTTAAAAAAAAAAAAAAAAAA

>gi|27436975|ref|NM_012282.2| Homo sapiens KCNE1-like (KCNE1L), mRNA
CGCGCTCGCCGGAGAGCTGGGTGCTACCGCTGTTTCCGCTGCTGAGCCCTGCCCGCCGGCCGGCCCGCTC
GCTAGCTCGCTTCCCCTCGCCCAGGGGGAAAGGTCAGCAGCGTCCTGGAGCCGCCGTGTCACTCCCCGAA
AGCCATGAACTGCAGCGAGAGCCAGCGGCTGCGAACCCTTCTGAGCCGCCTGTTGCTCGAGCTGCACCAC
CGGGGTAATGCCAGCGGCTTGGGCGCTGGCCCTCGTCCCAGCATGGGCATGGGGTCGTGCCTGACCCTT
TCGTGGGCCGCGAGGTGACCAGCGCCAAGGGCGACGACGCCTATCTCTACATCCTGCTCATCATGATCTT
CTACGCCTGCTTGGCCGGAGGCCTCATCCTGGCCTACACCCGCTCCCGTAAGCTCGTCGAGGCCAAGGAC
GAGCCGTCCCAGGCTTGCGCCGAGCACGAATGGGCCCCGGGAGGCGCCCTGACCGCCGACGCCGAGGCTG
CCGCGGGCTCCCAGGCCGAGGGCCGCCGCCAGCTTGCCTCCGAGGGGCTGCCTGCCCTCGCCCAGGGCGC
TGAGCGGGTCTAAAACCACAGCCCCAGATTGCTGGTTCGCGCCCTCCTCATCTCGCTCATCCCTGGGCGC
GCCTCCCACCTTCCACCCCCAACTCCCTTCCAGGGTTCGCCTCATCTGAGGCCCAGATAATGGTGAGAGG
CCAGGAGACCTTGTCTGGAAGGCCCTGGAAGGAGAAGCACCACCTTACCCATTCGGGCCAGTTTCTCCCT
CTTCACCCCTGCGCCTCCACCCCTACCCCGCACATCCAACTGCACTAAACTGCCTCTGCTCTCTTGTCTT
CAGACAGCCCTGACAGCACGCTCCAGCCCTCTGGGAACTGAATCCAACACGTCCAACACTTGGCACTGAA
CTGAAGCAATGCATTCTATCAGAACTCTGGGCCGTCTAACTGGCAGCTGCTCCAGGGGCTGCCAGGGACT
GCTCACTCTGCAGAGCCAACGGGCTTGCCAGGCCGACTGCAGCAGCTCCAGCTTCCAGTTGCCTTAGGGA
CAGAGACAAAGGAAATGAAGAGACCTCAGACATCTTTTCCCTCCCTCTCTCTTTCAGCAGGGAGCTAGCA
GGACACTAGGACCAGTCTGTGGGATAGAATGAACTTAATGGGGGACGGAAGGGGAGGAGTGCTCAACGG
GGAGGGAAATGATCTATGACTCCAACCGTATGATTTTCTTGCCTCCCAGTTTTCATCCCAGTGGTAACG
CCTGATTTTTGGTAGCTATGCCATCTTCTGCTGAGGATTACCATTACTGGGTGTATCACCCCAGTACTTC
CAAATGCCTCTCCTCTATTGATTCAGTTGTTATTGCAGTGTCTGCTTCATCCGTGGAACTTGAGGCTCAG
ATGCCCCTGCTCTGTAACCCTGGGGAATGTCAGAGGCAGGTAATAAAGGTTGTTTAAACAATAA >gi|32130539|ref|NM_012395.2| Homo sapiens cyclin-dependent kinase 14 (CDK14),
mRNA
```

Figure 20 (Continued)

```
GCATCCCCTTGATTAAATGTTTTTCCTCCTATGCAATCACCATTAGCTGTTTGGCTCCCATTCTGTATTC
TTCTGAAGCAGCCCTGCATTGCAAATCAATATCTTTCTGAAAAGACAGTGTGTTGTGAATTGCCTTGACA
GCATATGCACGGTTACTTTGGCTGCAATGCTGCTGCAGAGCCCGGTTACTCTGCCTTCGTGGGAACTCCA
CAGATATGTGTCACAAAGATGTCTACACGGAACTGCCAGGGAATGGACTCAGTGATCAAACCCCTGGACA
CAATTCCTGAGGATAAAAAAGTCAGAGTTCAGAGGACACAGAGCACTTTTGACCCATTTGAGAAACCAGC
TAATCAAGTAAAGAGGGTGCATTCTGAGAACAATGCTTGCATTAACTTTAAGACCTCCTCCACTGGCAAA
GAGTCACCTAAAGTTAGGCGGCACTCCAGCCCCAGCTCGCCAACAAGTCCCAAATTTGGAAAAGCTGACT
CATATGAAAAGCTGGAAAAACTAGGGGAAGGATCTTATGCTACAGTATACAAAGGGAAAAGCAAGGTAAA
TGGGAAGTTGGTAGCTCTGAAGGTGATCAGGCTGCAGGAAGAAGAAGGGACACCTTTCACAGCTATCAGG
GAAGCTTCTCTTTTAAAAGGACTAAAACATGCTAACATAGTGCTACTTCATGACATCATCCATACCAAGG
AGACGCTGACACTTGTGTTTGAATATGTGCACACTGATTTATGTCAGTACATGGACAAGCACCCTGGGGG
GCTGCATCCAGATAATGTGAAGTTGTTTTTATTTCAGTTGCTGCGAGGTCTGTCTTACATCCACCAGCGT
TATATTTTGCACAGAGACCTGAAACCACAGAACCTTCTGATCAGTGACACGGGGAGTTAAAGCTGGCAG
ATTTCGGTCTTGCAAGAGCAAAATCCGTCCCTAGCCACACATACTCCAACGAAGTGGTTACCTTGTGGTA
CAGACCTCCAGATGTCCTTCTAGGCTCAACAGAATATTCCACCTGCCTTGACATGTGGGAGTAGGTTGC
ATCTTTGTTGAAATGATCCAAGGAGTTGCTGCTTTTCCAGGAATGAAAGACATTCAGGATCAACTTGAAC
GAATATTTCTGGTTCTTGGAACACCAAATGAGGACACATGGCCTGGAGTTCATTCTTTACCACATTTTAA
GCCAGAACGCTTTACCCTGTACAGCTCTAAAAACCTTAGACAAGCATGGAATAAGCTCAGCTATGTGAAC
CATGCAGAGGACCTGGCCTCCAAGCTCCTACAATGTTCCCCAAAGAACAGACTGTCGGCACAGGCTGCCT
TGAGCCACGAGTATTTTAGTGACCTGCCGCCACGGCTATGGGAACTCACCGACATGTCTTCTATTTTTAC
TGTCCCAAATGTGAGATTGCAACCAGAAGCTGGAGAAAGCATGCGGGCCTTTGGGAAAAACAATAGTTAT
GGCAAAAGTCTATCAAACAGCAAGCACTGACAAGCAGCACATTCTCAAGAGCACACAGGATTAAGTTGTC
ATCATTCTGGGAAGAAAAAAAAAACATTAATGAAGAGGCCAATAATATGAAGGGAATCATGGATCAGTTT
TCTTTCGCTCCCTGTGGTGGATTTCACTTACAAGAAAATTGAAGCTGGCAAGACCCTGTTTTCTCTGCAA
TTTATTTAAAACCTTGCACGCATTTGGATACCTTGTGATTTCCAAGAACTACGTGAAGATTAAGCTTTGC
TTACTGATACATGGCATGTATTCTTTTCAGTCTTTTGTGTTTGATTTTGTTTGATTTCCCTCTGCAGCAC
AGCGTCTCTGTAAAGGTTTTTATGCTTTCACCAGCCATGTCTTAAATACATTAAGACAACACATTTGGTG
TTCACACTTCTTCAGTAATGTCTGAACTTGAAAGCCACAGAGTGGCATAAAACAATGTGTGTTTTCTTTG
AGAGCAGTGCACATTTTGCAACCACTAGGAAGGAAATTTTCTGCTAAAGCAAACCCCTGTTCTCTGACTT
GACAACTTGGCCCCGGACTGTGGGGCCCCACCTGTTGCTTACCTTTTGAGGTAATTTTGCAAATGTGGTT
TTTTTACTTGGAAATAACTGCACATTTATATATAGGATATTGGACTCTGCTTAGCATTTTCAAGCCACAT
AGCATGACTGTTTTTTGAATAGGTTGGAATTGAAAAAACAATTATCAAACGTTAAGAACAAAGACAGGGA
TAAATTGCTTACATTTCAACCTCTAGAGATTGAGGTAACTTTTTGTGTCTGGGTCTTGTCAACATCTAAT
TTTTTTCCATCCATTCTGTTACACTTTGTATTTCTAACTGGAGAAAAGAGTGAGGAACAGAATGTTTTA
AATCTGGTGCAAAAGAACTATATCTGCTGGATGAGCCTTGAAAGCAGTCTTGGCCTGTTAGGGCTTACAA
AGTAAATTACAAAGTGATCCAGTTCAAAGTTTGCTTAGTTACAACAAAGCACCTTTAAAAAAAATACATT
TTAAAAAAACATTCCAAGCCAATTGGAAGACATCATTGGGTTCTTACTTTAAGACATCTCCTGGAATAAC
TGTTCAAATGCAGGTTTTAGAAACAATGCAGGAATCTTGCTTTAAAGATGAAAAAGGGAATGGGCCAGCT
TCCCTTACTCAAGGAGTTGAGGGACCTTGGAGGATGAAGGCGAGTATGTGACACTGGAGAAAAGTGGACC
AGGCATGTCTTTTGCTTTGATCTGGAGGGAGGGCTGCCTGATGCAGGCCGGCTCCCAGTGGGCAGGCCT
CGCTGCAGAATGCCCAGTAGTACTGCGGCCAAGGGACAGTTAGGAGACTTCATCTAAAGCATGAAACCT
AGCTCCTCTACACACAAATTCCTATGGAAATACCTTTGTGTACAGTGTCTTACATTTTCCTATTAGTCAG
```

Figure 20 (Continued)

```
AAAGAAGGAGAGAATGAGTGAGTGCTTGAAATGTGTCATACTGTTTTAGGATCAAGACTAGGAATTAGGA
GCCAGGTTGACAAGGACTTTTTCTGAGAGTTGGGTGAGGGTAAAGCTTTTCTATAATCAAGCTCAATACA
CCAAGGAAACTGGATCCAGAATTCCTAAACTTTAAAATGGTACTGTCTGCGGAGTGGAGTATGGATGGTT
ATGTCAAAGTCATAGTTCATCCTATCCAGATGTAGCATTCATGGTAAACTTTTAAGTGCTAAGCAAGGAA
TTATTTACTGATTGGTTTTAAAGAGAGCAGAAAACACCCAAGTGTAGAATGTCTACTGTTTGCTACCTAG
AAATCTTTTCCATTCCTCTTTCATACATTCCAACCCACTGGAAGTCTTTAGAGGTATTTTGATTTAAAGT
ATACTTAAATTAGGATTTCTTAAAGAAAACATAGGGAGAAAACTTTACATGCAATTAAAAATGGACTTTC
CTGTGATTTGTTTTTAATCATTCATTTGGAGAAGAGGCATGACCTTTGTATTTCACTAAGTTTAAAGCAA
GAGCAACTGATGATTAAATGTTGCTTTTTAATAAGGTTTTTAACTTGAAAATTTGAAAATATTTAATGTT
GAAAGACTTCAATTAGGGCTATTAGAGTTATATCTCCCTGTCGTAGGCAGCTTCTTCGGAGAAGTGAAAT
ATAACATTACTCAGTGGACGGAGAAGTCTGTTTTGTTACAGAGACATGCCTCTCAGAAGGTCAGGAGGTT
TTGAGTACCTATCCTTGCCACCCATACAGGAAATCCAAAGTTTGGTGTCTCTCTCTCTGTCTCTTTCT
TTCTCTTTCTCCCCCAAACCCCTCTCACTCCCTCCCTCCCTCTCCTTCCCTATTTGCAATCATATT
CTCCCTCTGCTTCTTTTCTCTTCTGCCCTCCTTGTGGGCAGTCATGAAAATCAATTCAGACTGTGTTCAT
TAGCAGATTTATTATTCTATTGAGAAAGCACTGGAATGTTTGTGAGATTATTTTTATATGAAGGAATAG
CCTGAACTCAAACAGATGGTAAGAATAGTACAAACACCTTAGCACATCACTGCACACACAGTATTCTGAA
AGGAGATTTGACACTTAATTCCCATTTTCTTAAAATAACAGTTTTGTTGACTTAAAAATATGAGATACAT
AGGATGTGAAAAAAAATGTTTGCAGTACTCAGCAAAAAATAGGGTACATAAAGCAGGGTGGCTGTCCATC
CACTGATTCTGGGGTGAGAAGCGATTTCTACCTCGCAAGAGTGACTAGAAAGTTTCTAGGAGCACCTCCA
GGCTTGCAAAGAAAGTGAGGCCTCTTGGTATCCTTTCCTCAGTGTGTATATGACAGCCAGTATAATCAAT
ACCCTAGGTTATGCGTCTATATGATACTCATCTGTGAATATTATTGGTTTTGTAATCTTTGTTATATAAG
AGGATGTTTAGGCTGTATATACTGGGGTAGATTATTGCCTGCCCCTTATACATAGGAATATGCTGCATAA
TTGCGCATAACTTCCATCTCCCTTACTGGCTTGTAGGCAGAGGAAACTGTATATGTTACTGCCTTGTACT
TTTCTCATACACCAAAAACACACCAAAAAAATCAATAAAATAAGCAATCTTCTATTCTCATTCCTTTTCC
CACAGCAGCATATTTTAGAGGCACATACAAAACCTACATTCTCTAGTTGGGAGTGGATTTTTAAAGTTTT
CCTTTTATCTTTTATTTTTTTTGTATGATGCACTGAGATGTGTACTTTCTAACAGGGGATTGGTACCTA
AGAAATGTGGTAGCATTATTCAGAAAACTATTATACTTTCAAATGACACATAGTAAGGAGAATGGAATAA
TACATGTTGCATATTTGTTACCAGTTGTAATTTGTCTGTATTATGAAAGATGTAATGGTTTGTCAGCTGT
CACTGTTGTTTTCTTGTAACATGATATGGAATAAAGTATAGCAGAATCTCCGT
```

>gi|68216098|ref|NM_012413.3| Homo sapiens glutaminyl-peptide cyclotransferase (QPCT), mRNA

```
GGCGATGGGAAGGCGGGCGCAGTCGACCCAAGGGTGGAGAAGAGGGAAGGCGAAGGACGCGCGTTCCCGG
GCTCGTGACCGCCAGCGGCCCGGGGAACCCGCTCCCAGACAGACTCGGAGAGATGGCAGGCGGAAGACAC
CGGCGCGTCGTGGGCACCCTCCACCTGCTGCTGCTGGTGGCCGCCCTGCCCTGGGCATCCAGGGGGTCA
GTCCGAGTGCCTCAGCCTGGCCAGAGGAGAAGAATTACCACCAGCCAGCCATTTTGAATTCATCGGCTCT
TCGGCAAATTGCAGAAGGCACCAGTATCTCTGAAATGTGGCAAAATGACTTACAGCCATTGCTGATAGAG
CGATACCCGGGATCCCCTGGAAGCTATGCTGCTCGTCAGCACATCATGCAGCGAATTCAGAGGCTTCAGG
CTGACTGGGTCTTGGAAATAGACACCTTCTTGAGTCAGACACCCTATGGGTACCGGTCTTTCTCAAATAT
CATCAGCACCCTCAATCCCACTGCTAAACGACATTTGGTCCTCGCCTGCCACTATGACTCCAAGTATTTT
TCCCACTGGAACAACAGAGTGTTTGTAGGAGCCACTGATTCAGCCGTGCCATGTGCAATGATGTTGGAAC
TTGCTCGTGCCTTAGACAAGAAACTCCTTTCCTTAAAGACTGTTTCAGACTCCAAGCCAGATTTGTCACT
```

Figure 20 (Continued)

CCAGCTGATCTTCTTTGATGGTGAAGAGGCTTTTCTTCACTGGTCTCCTCAAGATTCTCTCTATGGGTCT
CGACACTTAGCTGCAAAGATGGCATCGACCCCGCACCCACCTGGAGCGAGAGGCACCAGCCAACTGCATG
GCATGGATTTATTGGTCTTATTGGATTTGATTGGAGCTCCAAACCCAACGTTTCCCAATTTTTTTCCAAA
CTCAGCCAGGTGGTTCGAAAGACTTCAAGCAATTGAACATGAACTTCATGAATTGGGTTTGCTCAAGGAT
CACTCTTTGGAGGGGCGGTATTTCCAGAATTACAGTTATGGAGGTGTGATTCAGGATGACCATATTCCAT
TTTTAAGAAGAGGTGTTCCAGTTCTGCATCTGATACCGTCTCCTTTCCCTGAAGTCTGGCACACCATGGA
TGACAATGAAGAAAATTTGGATGAATCAACCATTGACAATCTAAACAAAATCCTACAAGTCTTTGTGTTG
GAATATCTTCATTTGTAATACTCTGATTTAGTTTAGGATAATTGGTTCTAGAATTGAATTCAAAAGTCAA
GGCATCATTTAAAATAATCTGATTTCAGACAAATGCTGTGTGGAAACATCTATCCTATAGATCATCCTAT
TCTTATGTGTCTTTGGTTATCAGATCAATTACAGAATAATTGTGTTGTGATATTGTGTCCTAAATTGCTC
ATTAATTTTTATTTACAGATTGAAAAGAGGGACCGTGTAAAGAAAATGGAAAATAAATATCTTTCAAAG
ACTCTTTTAGATAAACACGATGAGGCAAAATCAGGTTCATTCATTCAACGATAGTTTCTCAACAGTACTT
AAATAGCGGTTGGAAAACGTAGCCTTCATTTTATGATTTTTTCATATGTGGAAATCTATTACATGTAATA
CAAAACAAACATGTAGTTTGAAGGCGGTCAGATTTCTTTGAGAAATCTTTGTAGAGTTAATTTTATGGAA
ATTAAAATCAGAATTAAATGCTAAAAAAAAAAAAAAAAA

>gi|209870093|ref|NM_012437.4| Homo sapiens SNAP-associated protein (SNAPIN),
mRNA
GGGGCGGGGCAGTGCGGCGCGGCTCCGGTTCCCGGCGGCCCTCGCGGCAGGTTTCGGGCTTCAGGACAAT
TCGTGATGGCGGGGGCTGGTTCCGCCGCTGTATCGGGGGCAGGGACCCCGGTGGCGGGGCCCACAGGCCG
CGACCTTTTCGCCGAAGGGCTGCTGGAGTTCCTGCGACCCGCTGTGCAGCAGCTCGACTCTCACGTACAC
GCCGTCAGAGAGAGCCAGGTAGAGCTCCGGGAACAAATTGACAACCTAGCCACAGAACTGTGCCGCATAA
ATGAGGATCAGAAGGTGGCCCTGGATCTTGACCCCTATGTTAAGAAGCTACTTAATGCCCGGCGACGCGT
TGTCTTGGTTAACAACATTCTACAGAATGCTCAGGAACGACTGAGACGGCTAAACCACAGTGTTGCCAAG
GAAACAGCCCGCAGGAGAGCAATGCTGGATTCGGGAATTTACCCCCCTGGCTCCCCAGGCAAATAACAGA
TGAGCCTATGGACTCAGTAGCACAAGTACTGTTCCCCAGCTGCCTTGTTTCAACAGACATGCAAAGATCC
TAGGAGACAGTCCCCATAGACCTTCAGACATTAAAAAGGGAGCCGTACAGTTTGTTTGAAGCACTTCGTC
TTACCCATTTATGTAGGGGCCCCAGGAAACCTACACACAGCCAGAATGAGGTTCCCAAAGGACTTACATT
AATTATGGCTCTTGCTTCCTTTCACAAATGAGCTGAGGCCTCTACTTTTTTTTTAAGCTGCATACGTGA
GGCTTACCTTCTTCAGGACTAGTTAACCAGAGGGGCTTCCTTTGTATGTTACATGCCTGGTTACATGGGC
CTGGACAGCATGTCCTCTACCTGTGACTTCTCATTTTCCTGTTTACACTGGGGATTTGGAGGGGGCAGGC
AAAGTCAAAGTGAATGACCTCTGTCCACCCACTTTTTTATTGCACTGGCTTGAATACAGTAGCAGTGTTG
ATAGAATCATTTTATTCAATAAATACTTAAAATGATATTCTAGTTTACTCTGGTAAAAAAAAAAAAA >gi|149192860|ref|NM_013332.3| Homo sapiens hypoxia inducible lipid droplet-
associated (HILPDA), transcript variant 1, mRNA
GGGGCGTGCTCGCGGCTATAAGGGGCGGAGGCTGGGCGGCGTTGCTCTGCGCTCTGCGGCTGACGGCGCT
TTTGTCTCCGGTGAGTTTTGTGGCGGGAAGCTTCTGCGCTGGTGCTTAGTAACCGACTTTCCTCCGGACT
CCTGCACGACCTGCTCCTACAGCCGGCGATCCACTCCCGGCTGTTCCCCCGGAGGGTCCAGAGGCCTTTC
AGAAGGAGAAGGCAGCTCTGTTTCTCTGCAGAGGAGTAGGGTCCTTTCAGCCATGAAGCATGTGTTGAAC
CTCTACCTGTTAGGTGTGGTACTGACCCTACTCTCCATCTTCGTTAGAGTGATGGAGTCCCTAGAGGGCT
TACTAGAGAGCCCATCGCCTGGGACCTCCTGGACCACCAGAAGCCAACTAGCCAACACAGAGCCCACCAA

Figure 20 (Continued)

```
GGGCCTTCCAGACCATCCATCCAGAAGCATGTGATAAGACCTCCTTCCATACTGGCCATATTTTGGAACA
CTGACCTAGACATGTCCAGATGGGAGTCCCATTCCTAGCAGACAAGCTGAGCACCGTTGTAACCAGAGAA
CTATTACTAGGCCTTGAAGAACCTGTCTAACTGGATGCTCATTGCCTGGGCAAGGCCTGTTTAGGCCGGT
TGCGGTGGCTCATGCCTGTAATCCTAGCACTTTGGGAGGCTGAGGTGGGTGGATCACCTGAGGTCAGGAG
TTCGAGACCAGCCTCGCCAACATGGCGAAACCCCATCTCTACTAAAAATACAAAAGTTAGCTGGGTGTGG
TGGCAGAGGCCTGTAATCCCAGCTCCTTGGGAGGCTGAGGCGGAGAATTGCTTGAACCCGGGGACGGAG
GTTGCAGTGAGCCGAGATCGCACTGCTGTACCCAGCCTGGGCCACAGTGCAAGACTCCATCTCAAAAAAA
AAAGAAAAGAAAAAGCCTGTTTAATGCACAGGTGTGAGTGGATTGCTTATGGCTATGAGATAGGTTGATC
TCGCCCTTACCCCGGGGTCTGGTGTATGCTGTGCTTTCCTCAGCAGTATGGCTCTGACATCTCTTAGATG
TCCCAACTTCAGCTGTTGGGAGATGGTGATATTTTCAACCCTACTTCCTAAACATCTGTCTGGGGTTCCT
TTAGTCTTGAATGTCTTATGCTCAATTATTTGGTGTTGAGCCTCTCTTCCACAAGAGCTCCTCCATGTTT
GGATAGCAGTTGAAGAGGTTGTGTGGGTGGGCTGTTGGGAGTGAGGATGGAGTGTTCAGTGCCCATTTCT
CATTTTACATTTTAAAGTCGTTCCTCCAACATAGTGTGTATTGGTCTGAAGGGGTGGTGGGATGCCAAA
GCCTGCTCAAGTTATGGACATTGTGGCCACCATGTGGCTTAAATGATTTTTTCTAACTAATAAAGTGGAA
TATATATTTCTAAAAAAAAAAAAAAAAAAAAA
```

```
>gi|85067506|ref|NM_013354.5| Homo sapiens CCR4-NOT transcription complex,
subunit 7 (CNOT7), transcript variant 1, mRNA
ATCTAGCGCCCCCGTCAGGACGTGCGAAAAGCGACGGCGCAGCACGGTGCGGCGCAGCTCCTGCTCGCCT
TTCCCTTCGCTGGGCGAGAGGTGTCTATGGGGCACCCGCTGCCGCCGCCGCTACCGCCACCGCCACCGCC
ACCGCCGCCGAGTGCTGTCTCTATGGCGAGGAGGAGGAGGAGGAGCGCGAGCTCAGCGACACAAGTACAT
AAATAAAGGATAAATATTTTATGAAACAAATCTTCAATCAAGTATAACATTTTGATGCTTGGCATCTAG
ACTCCCTTGTGCCCTCACTATGCCAGCGGCAACTGTAGATCATAGCCAAAGAATTTGTGAAGTTTGGGCT
TGCAACTTGGATGAAGAGATGAAGAAAATTCGTCAAGTTATCCGAAAATATAATTACGTTGCTATGGACA
CCGAGTTTCCAGGTGTGGTTGCAAGACCCATTGGAGAATTCAGGAGCAATGCTGACTATCAATACCAACT
ATTGCGGTGTAATGTAGACTTGTTAAAGATAATTCAGCTAGGACTGACATTTATGAATGAGCAAGGAGAA
TACCCTCCAGGAACTTCAACTTGGCAGTTTAATTTTAAATTTAATTTGACGGAGGACATGTATGCCCAGG
ACTCTATAGAGCTACTAACAACATCTGGTATCCAGTTTAAAAAACATGAGGAGGAAGGAATTGAAACCCA
GTACTTTGCAGAACTTCTTATGACTTCTGGAGTGGTCCTCTGTGAAGGGGTCAAATGGTTGTCATTTCAT
AGCGGTTACGACTTTGGCTACTTAATCAAAATCCTAACCAACTCTAACTTGCCTGAAGAAGAACTTGACT
TCTTTGAGATCCTTCGATTGTTTTTTCCTGTCATTTATGATGTGAAGTACCTCATGAAGAGCTGCAAAAA
TCTCAAAGGTGGATTACAGGAGGTGGCAGAACAGTTAGAGCTGGAACGGATAGGACCACAACATCAGGCA
GGATCTGATTCATTGCTCACAGGAATGGCCTTTTTCAAAATGAGAGAAATGTTCTTTGAAGATCATATTG
ATGATGCCAAATATTGTGGTCATTTGTATGGCCTTGGTTCTGGTTCATCCTATGTACAGAATGGCACAGG
GAATGCATATGAAGAGGAAGCCAACAAGCAGTCATGACATGAAATAGTCCTTTTATTTTTATTTCGAGCT
ACACACATGCTTGTATATAGGTTTTATCTCTGGTTGAATCCCTCGAACAATAGACAGTACCTTTCCCCCC
CCTTTCATGGCCCATTTATTGTCTGCCTTTCAGTACTAAGTATGACCGTTCCTATCTCAGATCTTAATA
AAAAGAAAAAAAAAAACGCATTCAGGTTAAATTTGGCCTTAATTTAATATACTTGTTAGCAAGCGTGTGT
GACAGAGAGTGGGGAAAGCTACATCATTGAATATTTTGATAAACTTTACCGACTTGAGTTTGGTTTATTT
TTCCCTTTTCCTAAATTAACTAGCACTGACTGTAATTTATTTCCCTGTTTCACGTCTCTCCCTTCCATTC
TGCAGGAGTTTTAGCTATTTGAGATCGTGGACCATCAGTTTTGCACTTTAGAGAGTGTTTCTGACTCTAA
ACCTGTTTTATCAGAAAATTTGTTTTTTCTTGATCTTAGCTGGAAAAATCTGCCAACTTTACACAGTATT
```

Figure 20 (Continued)

```
TACTTGGTTTTGACCCACAGAATATAGCACGTTGTGCAAACTGTCGATTCAGCGAAACTTAAAAAGACA
AGAAACTACTGAGGAGCTTAGTAACTGCTGTTTCTGTACGTAGTGTTTAATCTTCCAAGCACATCTAGTG
TCTGTCAGTTTCTAATTGGCATGTGTAGGCTGCTCTGTGACTGAAGAATTTTCAAACCAGCTTTACACCC
TTCAGGAAAAATCCCTTGTGATTGGATGTTTACTATCTGCCAGGAAACTGGTACTCAAGATGTTGAAGCT
ACAGTTATTTTATGATAGCACACTTCCCTTGATCTGCTTATTTTATTCCATCACCATTTACCCTTTTTT
TTTTTTTAAATTTTGTAGCCATTCTTATGATGCTCTTGATTTGTTGGTTACACAAATCAATTTTATTAAA
AATCCAAAGATAAGTCTTTAGGTATATTTTGTACCAAATTAAATTAGAAGACAAAAATTGTGCTTTCATA
GTTGCTACAAAGGTAAATAATGGAGAGATTTGGTACAAAACAACAAAATATATATATATTCTCATATATA
TATATATAGCTGATAAAATTACCTGAGGAGTGTAATGCTTATTTTTTGTGTATATCTTTGCAATCTATT
TTATATATATTGACAAAAGAGACTGTGAAATACTTAGCCATGCAGAATATGTGACCAGACCAGAGCATGT
GTAGGAAGACTTTACGGTAATCATTAACTCTACCCCGAAATGATGGACTACAAGTTATAATGTGTGTTAC
CTACACTTCAATCAGTAATATTAGCAAATCTCCAAATGTTAGTCACATTGGTTTGTCTCCCTTGTACATT
CTTTATTCATGATATTACAGTGCTGTAACTGGGTGGTCCTTTTTAAACAAAACATTATTTGCAAAACAGA
GGGTATTATTTGTTTTTAAAGCTTTTGTAAATAAAGGCTTCAAAATGTTTTCTTAT
```

```
>gi|298566319|ref|NM_013410.3| Homo sapiens adenylate kinase 4 (AK4), nuclear
gene encoding mitochondrial protein, transcript variant 6, mRNA
AGGTGGAGAAGGGCGGGGAGGTGTAGCGTGGCGCTCAGTCCGCCTGCTACTCGGTCCCGGCGCTGGGCTG
AGGGGAGGGGTTGTCTTAAAAGTCTCTCCTTCCCCCTGTAGGGGCGGCCGGCGAGTCCCAGTGAGAGCGG
AGGGTGCCAGAGGTAGGGGCCGAGAAACAAAGTTCCCGGGGCTTCCTCCGGGGCCGCGGTCGGGGCTGC
GCGTTTGACCGCCCCCCTCCTCGCGAAGGCAATGGCTTCCAAACTCCTGCGCGCGGTCATCCTCGGGCCG
CCCGGCTCGGGCAAGGGCACCGTGTGCCAGAGGATCGCCCAGAACTTTGGTCTCCAGCATCTCTCCAGCG
GCCACTTCTTGCGGGAGAACATCAAGGCCAGCACCGAAGTTGGTGAGATGGCAAAGCAGTATATAGAGAA
AAGTCTTTTGGTTCCAGACCATGTGATCACACGCCTAATGATGTCCGAGTTGGAGAACAGGCGTGGCCAG
CACTGGCTCCTTGATGGTTTTCCTAGGACATTAGGACAAGCCGAAGCCCTGGACAAAATCTGTGAAGTGG
ATCTAGTGATCAGTTTGAATATTCCATTTGAAACACTTAAAGATCGTCTCAGCCGCCGTTGGATTCACCC
TCCTAGCGGAAGGGTATATAACCTGGACTTCAATCCACCTCATGTACATGGTATTGATGACGTCACTGGT
GAACCGTTAGTCCAGCAGGAGGATGATAAACCCGAAGCAGTTGCTGCCAGGCTAAGACAGTACAAAGACG
TGGCAAAGCCAGTCATTGAATTATACAAGAGCCGAGGAGTGCTCCACCAATTTTCCGGAACGGAGACGAA
CAAAATCTGGCCCTACGTTTACACACTTTTCTCAAACAAGATCACACCTATTCAGTCCAAAGAAGCATAT
TGACCCTGCCCAATGGAAGAACCAGGAAGATGTGGTCATTCATTCAATAGTGTGTGTAGTATTGGTGCTG
TGTCCAAATTAGAAGCTAGCTGAGGTAGCTTGCAGCATCTTTTCTAGTTGAAATGGTGAACTGATAGGAA
AACAAATGAGTAGAAAGAGTTCATGAAGAGGCCCTCCTCTGCCTTTCAAAAGGCTGGTCACCTACACATG
TTTAAGGTGTCTCTGCACATGTCTCAAGCCCATCACAAGAAAGCAAGTACAGTGTGGATTTCAAATGGTG
TGTAACTTCAGCTCCAGCTGGTTTTGACAGCTGTTGCTGTGGTAATATTTTTGACATGTGATGGTGATA
GTCTCTGGTTCTCCCCATCCCCACAAAGGCTGTTGAACCACAGCACCAGGAAGCCTGAGAATGAATCCTG
AGGGCTCTAGCCCAGGCTTTGTCCCAGGCTTTCTGGTGTGTGCCCTCCTGGTAACAGTGAAATTGAAGCT
ACTTACTCATAGTGGTTGTTTCTCTGGTCTTGAGTGACTGTGTCCACAGTTCATTTTTTCCGGTAGGAA
TAACTCCTTTTCTACATCCACGCTCCATAGAGTCTCTCCTTTTCAGACATCCTGGGATGAAAGAATTTGG
CTTTTTTTTTCTTTTTTTTTTGGACATCTGTTTTCACTCTTAGGCTTTTAAACAATAGTTATTGCTTT
TATCCCTCTCAGATTCTAATAACTGAGAGCGATGGGGCTATATTGAATCTCTGTATGCACTGAGAACTGA
GCTATGAAGAGGATCTTATTAAACTGCTGGTCTGACTTTATGGATTGACACTGTTCCTTTCTTTTATTGT
```

Figure 20 (Continued)

```
GAAAAAAAAAAAAAACCCTGAAAGTCTTGGGAACCCCCTAAAGTCTTTTGGGAATCCTCAAAAAGCATGG
GAAGTTAAGTATTTAGCTACATAAATGTTGTAAGATCATATCTTATGTATAGAAGTAATAAGACCATTTG
GAATTACTGGACTAATTGAATAGTTAAGGTTTCTATTCGGGACAATAAAATGTATTTTGAAAGTGCTGCT
AACTATTGATGCTGACAGTGTTTCACTCCTATGAGTGACCCAAACATATTATAAATATGTGGTAAAGGGA
ATGGAGCCTGTGGGGTTGAGCAGAATGTTGTACTAGCTGTGCCTGGACTGAGTATAACAGCTTTATGATT
ATGAGAAAACAAATTCTTTATTTTTTTTTCTGTTCCAAAGATTCATCCTATGGGGTGGCCATAAAGTCT
AGAATTAGATACTAATATTTTGTCATTCATTATAACATATCAATAAACCATTTGTTAAAAGATTTGCCTG
GTTTCCAGACTTGGTGGCCACCTTGAATAATTCTTGCTGTCTTCTGGGAAGGATGATGAAATTTATTCCT
GCTGCCTTAAAAATATGTATCCCTTCTTCACCCATCATGACTGTCCCCAGTGAGTGTCCTTTACTATTCT
TGGGAGTGACTCCTGTCTAACTTTTCATACTGGCGAGAAGAAAAGAAGCCTATTTTAACACTTTAGTGGT
GTTGAAACACATTACTTACTTTCTGAAGATGTCCCAGTGAATCCTCTGTCAATTCACTGCCATATGTAAT
CTATATGATAAGGAATGCATCTTCCTTCTAAGTACTGCCCAAACTCTTGCCAGCTCCTCTCCCATTGTCC
CTTCATGTGAATATTTCTTGGCTACCTTAGTGGAAATATAGATCAGTTTTCTCCCCATCCATCCTCTCAA
ACATAATGAGATTGTTTACTTTTTAGATTTATGCAGTGAAAATGCCCAGTCAGGTCTGAATCGTCAGTGC
ATTATATTGACTCTGAGCACTTTAGAATTTAGAGTTGCAATTGAATGCCAGCTGTGGAGATGGGGTGCAT
ATCAGATATATAAATAAAGCTCAGGTTTGCTAGGGAACCAGGTATAGAGAAAAATAAGTCTGATATGAGG
AAAATTGCACAATTTAGAGTAGTTATGCCGTAGAGAAAATTTCCACAAACTAGGAAATGTAGAGAGTTAT
TCTATAGAATACTCAAAAGAGGAAAGTATGTGATTTTTGGAAACAGGAAAATCTTCAAACTTCTTTCTTC
ACTTCCCTTTGTGTTTAGCTGACCCTCCAATGTGATCATTGCCTTTGGAGTTTGGGAGAGGTACGGGAAG
TGGCCTGATCCCTGCTTCCATACTTCACTCCTCCATCCATCCTTCCCTCCCTCTTCCCCTCCAGCTAAAT
GGACAATTCTAGCCAACATTGAGTCACTCAATAAGTCTCAACAGTGGGTGTGTTTGCTGAGATTGTCCAG
CGGTTGAGCAGTTTGGTCTCACCTCCCTCGCTAGTTGAGACCAAAAAGAGACAAATAACTTTTTCATGGT
CTTTGAAACATAATGCTTATTTCGTGGTCAATGGCTTTAAAAAAATCTGTTTCTTGTTTTCTTCAACAAA
CTCACTAGTTTTCCCTTAAATGATATTGTAAAAATTAAAGTAATCTTGAAAATGTTTTGACAAAAGTAAA
ATTAAAGGGACATCTTTTCTTGTTTTGTTTTTTTTTTTCTATTGCCACACATGACCGTTCCTTCACCTT
TAAGCAAAGAGAGTGGTTCAGATGGTTTCTAAGATGCCAACCTGACCTCGCATTCTGTCATTCTACCCAG
CTCTTAATTCAATTTGCTTCCATTATCCTAACAGGCTTCTTTCTTACTTAGAACTTGGAAAGGCTGCTGT
ATTTAATACCCTCCAACACTAACGCAGACTTAAGATAGGTACTGTTTATTGAAAACCTACTGAGTGAAAT
GTGCGGTTTTAGGACCTTCATAAACATCTCATTTAATCTTTCTAGCATCCTGTGAAACAGCCATGATTTC
ACGTTGATAAACAAAGAAGACAGGGGTCCCAGGGATGTGAAGCATCTTGCCCAGGCTTCTGCTGCTGGTG
ACCAGTGTAGCCAGGACTCCAGCCCAGGTTTTCCTGACTCAGAAGACTGAGCTTTTTCCTGGATGTTATT
AATAGCTAATTGTGTCCAAGCAACCAAGGGCCTTGAGTCTGCTTGGTTCTGCTTATGGCCTCACATCAAG
AAATGGAGCTAGTCCATGTCTGTAGTCCCAATGCTTTGGGAAGCCATGATGGGAAGGTTGTCGGAGGCCA
AAAGTTCAAGACCAGGCTGGGCAATATCACAAGACTCCATCTCTACGGAAAAGTAAAAAATTAGCCAGTC
ATGGTGGTGTACACTTATGGTCCTAGTTACTCAGGAGACTTAGGCAGGAGGATTGCTTGATCCTAGGAAT
TCGAGGCTGCAGTGAGCTATGATTGCACCTCTGCACCCAAGCCTGGGCGACACAGCGAGACCCTCTCTCT
TAAAAAAAAAAAATAGCAGAGCTCACCAAAGTGATGTTCACCTTTTTATGACATTCCTTTTTCTTAGCTT
AAGAAAAGAAAGCTGCTAGATGAGAGTCTTAGTTTTCCTGCATAAGACCTCCTTTATGAATAGAATAAAA
GACTGTCAAAGTAGGCTGGGCTTGGGCCCAGGCTAATCTATGAAGGAAGCAAGCTCGTGTTCCTTACCTA
TCCTTTTGGTGTCCATTGGATTGTGCCCCGAAGTGGCCTTTACCCTTGAGCCGTCCCCAGCCATGGTGCT
CACACATAGGCTTTTGAGCTCCTTGGAGCTATCCAGATCCTGCTCACTTTTCCTTCCTGAGATCAGAACA
AATCACCCCCTTACTCCCACTCCAAACAAGGCCTTGATGATAAACTAATCCTTCCTAAAATGCTGGTAGG
```

Figure 20 (Continued)

```
TAAACAAGCAATGATGAAGCATTGAACACAGGTTAACTCCTGACTTTTGTACCATTGTCTATTCCATTAC
ACATTAACATGACTCTGAATGCCAGATCCAAACCTTTGCCCACCATCTGCTTGTCGTGCAACAGTTGAGG
CAGTAACCAGGGGAGATTCACTTCCTGTCTTGTCCTTCCCCAGGGATCACCCCCCTGCTGCCCTCTAGCA
GCCAAACTCAGATGAGTTCCATTGTTACCCTAGGTGTGCCCATCTCTTTGGTAGGGAAGGAGAAAGGTAA
GAATAGCCATCAGTGAGGAAGGATTCTTGGAGCGAGGAGCCACTGTGGTTTTTCCTGCTATTTAAGATGT
TGAGACCGGATAACTTTAGAAAGATACCTGCACAAACCCATAAATAGTGCTTTTATAAAGTTTAGTTCAC
CGGAACCTGAGTTCAGTATTTGACATTAGCTTTTTGTCCAAAGAGTTGAAGCCTGCTGGAGGTCTTTGCT
CAAATAATAAATACCACATATTTCCAAGTGTGTTCAGGTATAGGCACTAGGTACTGTCTGTTTACTTCAT
GTTAGGCACATTACATGCATTGGCTAATCAAATCCTCATCAATTACATATGTAATAATCTAAACTTGCCT
CCTTGTATTATAAATGGAAATAATCCTGTTTATTTAAACGGGTTTTCATGTACCTGTAGGGATTAGGAAA
CTCAAATGGCCTTTTTAATACCTTTCCCTAGTTTGAGCTCCCTGTTCTCTTTAACAGATAAAACAACATA
TTTGCTTCAGCCTGGAATCTGTTTTTGGTGCTTTGGTGCAGAGACAGGAAATGGGCACTCAGAGTCACAC
TGGTAGTTGCACACTGTATCTACAGAGGGCGTGTCTCATCTGTACTCTGCTGGGTTACAGGATTTCAGTA
GGTATTTGTGTCCACCTGAGAATTCTGTTTATTACCTTTCATTTGACAGTGTCTTTCCTTTCTGCAGTTG
ATTTTGCTAGAGAGGCAATTCATAAGGTGAGGTCCTGTTCATAGTATGACTTGCTTTCTCAATATCTCCT
TCAATTTTTAGTAACTCTTGGTCTATTTGGTGTCTTTAAAAAAAATAACCTAGTAATAAAGACTTCTTTT
AATGTGGAAATGTGGTCTGGTAGTAAGTTATTTCTTTCCACATGTAACTGACCCAATCTGGTTTCCAAAT
GAGAAGTGTGCAGGCCCCAGAGGTTGAGAAGCCATATTTCAACTGTGAAAAAAATCTGCTTCCTGCATCT
GTTGAAATATAGTTGTTCATACTTGCCATCCCTTATCTTTCTTGTAACAATTTGCACAGTTCTTGCCAGA
ATAAATGCCATTATCTGTATGTTTCAGGGAGTTCCCCAATTTGATCATTTTTGTGTGTGTGTGGTGTGTG
TGTGAGAGAGAGAGATACTGCAGTAAAACATTTCTAAAGGATGAAAGCTCTTGTATGGCATAGATATGAA
TTCCTTCCTCTGGTAATAATTAGGTTATTCCCAGAAGCACAGTGTCATTCTTTAAATAAAAGCTTTCCTG
TTTAAAGCTTTTCAAAGGAGCAGACCACCTTGAAGATTCCCCCTAGGGTTGATATGTGTCTAATTCATTT
TATAAAAATTATTCTTGTCTTCATTTTAAAGCTTTGGCTATATAGTCAGAAATGTCCTAAATAACAAACT
ATTTTGTATTTAATTTAGGGAAGACTAAAGGGAAGAAAAATGAAAACTCAGTCTTTATGTAAGCTCCAAG
GATATTAGGGCTTAAAGGGCTTTTCTAGTTTTATGAGAATTTGTACTACTGATTTTTATATATTCCTGTT
TTTGAGATGAACAGATCTCTGGGGAAATTGTTGAGTTACAATGGCATTTCACTGTGATCCCTCTCAAGCT
CAGATCAGTTCTATAACCCAATGACAACCTGTCTCTTTGGTTTACTGTCCTGTGAAATGTCAGCTCAAGT
TTCCCAGAAGTCGTGTGTTTATGATGAGTCAGAGTGCTTTTCCTCGGTGGGACAGTTGCTGGCCCTCTTA
ATTTTGGTGTATGTGCTTCCAAGTATCTAAACCTCCAGTCTGATCTGTATATGCTATCCTAACTGTTAAT
TGTATTATTGATTATGTTGATTATCTTGCTTGAAGGTTCATACTTTTCAATTTGATAGAAATAAAGTTTT
TTTCTGCTTATAGCTAGCGAA

>gi|299782536|ref|NM_013975.3| Homo sapiens ligase III, DNA, ATP-dependent
(LIG3), nuclear gene encoding mitochondrial protein, transcript variant alpha,
mRNA
GCGCGCTGCCTCCCGCTCTAGGACCCGGATTTAAAGAGACAGGCGCTCCAACCGTCGTGGGCTGCCCGCG
GCCTGTAATGAGCAAGTTCCGAGGCCTACGGTGAGCGCCGGAGCCGGAGAGGCAGCTATATGTCTTTGGC
TTTCAAGATCTTCTTTCCACAAACCCTCCGTGCACTCAGCCGAAAAGAACTGTGCCTATTCCGAAAACAT
CACTGGCGTGATGTAAGACAATTCAGCCAGTGGTCAGAAACAGATCTGCTTCATGGACATCCCTCTTCC
TGAGAAGAAAGCCTGTTCTATCATTCCAGGGAAGCCATCTAAGATCACGTGCCACCTACCTTGTTTTCTT
GCCAGGGTTGCATGTGGGACTCTGCAGTGGCCCCTGTGAGATGGCTGAGCAACGGTTCTGTGTGGACTAT
```

Figure 20 (Continued)

```
GCCAAGCGTGGCACAGCTGGCTGCAAAAAATGCAAGGAAAAGATTGTGAAGGGCGTATGCCGAATTGGCA
AAGTGGTGCCCAATCCCTTCTCAGAGTCTGGGGGTGATATGAAAGAGTGGTACCACATTAAATGCATGTT
TGAGAAACTAGAGCGGGCCCGGCCACCACAAAAAAAATCGAGGACCTCACAGAGCTGGAAGGCTGGGAA
GAGCTGGAAGATAATGAGAAGGAACAGATAACCCAGCACATTGCAGATCTGTCTTCTAAGGCAGCAGGTA
CACCAAAGAAGAAAGCTGTTGTCCAGGCTAAGTTGACAACCACTGGCCAGGTGACTTCTCCAGTGAAAGG
CGCCTCATTTGTCACCAGTACCAATCCCCGGAAATTTTCTGGCTTTTCAGCCAAGCCCAACAACTCTGGG
GAAGCCCCCTCGAGCCCCACCCCTAAGAGAAGTCTGTCTTCAAGCAAATGTGACCCCAGGCATAAGGACT
GTCTGCTACGGGAGTTTCGAAAGTTATGCGCCATGGTGGCCGATAATCCTAGCTACAACACGAAGACCCA
GATCATCCAGGACTTCCTTCGGAAAGGCTCAGCAGGAGATGGTTTCCACGGTGATGTGTACCTAACAGTG
AAGCTGCTGCTGCCAGGAGTCATTAAGACTGTTTACAACTTGAACGATAAGCAGATTGTGAAGCTTTTCA
GTCGCATTTTTAACTGCAACCCAGATGATATGGCACGGGACCTAGAGCAGGGTGACGTGTCAGAGACAAT
CAGAGTCTTCTTTGAGCAGAGCAAGTCTTTCCCCCCAGCTGCCAAGAGCCTCCTTACCATCCAGGAAGTG
GATGAGTTCCTTCTGCGGCTGTCCAAGCTCACCAAGGAGGATGAGCAGCAACAGGCCCTACAGGACATTG
CCTCCAGGTGTACAGCCAATGACCTTAAATGCATCATCAGGTTGATCAAACATGATCTGAAGATGAACTC
AGGTGCAAAACATGTGTTAGACGCCCTTGACCCCAATGCCTATGAAGCCTTCAAAGCCTCGCGCAACCTG
CAGGATGTGGTGGAGCGGGTCCTTCACAACGCGCAGGAGGTGGAGAAGGAGCCGGGCCAGAGACGAGCTC
TGAGCGTCCAGGCCTCGCTGATGACACCTGTGCAGCCCATGTTGGCGGAGGCCTGCAAGTCCGTTGAGTA
TGCAATGAAGAAATGTCCCAATGGCATGTTCTCTGAGATCAAGTACGATGGAGAGCGAGTCCAGGTGCAT
AAGAATGGAGACCACTTCAGCTACTTCAGCCGCAGTCTCAAGCCCGTCCTTCCTCACAAGGTGGCCCACT
TTAAGGACTACATTCCCCAGGCTTTTCCTGGGGGCCACAGCATGATCTTGGATTCTGAAGTGCTTCTGAT
TGACAACAAGACAGGCAAACCACTGCCCTTTGGGACTCTGGGAGTACACAAGAAAGCAGCCTTCCAGGAT
GCTAATGTCTGCCTGTTTGTTTTTGATTGTATCTACTTTAATGATGTCAGCTTGATGGACAGACCTCTGT
GTGAGCGGCGGAAGTTTCTTCATGACAACATGGTTGAAATTCCAAACCGGATCATGTTCTCAGAAATGAA
GCGAGTCACAAAAGCTTTGGACTTGGCTGACATGATAACCCGGGTGATCCAGGAGGGATTGGAGGGGCTG
GTGCTGAAGGATGTGAAGGGTACATATGAGCCTGGGAAGCGGCACTGGCTGAAAGTGAAGAAAGACTATT
TGAACGAGGGGCCATGGCCGACACAGCTGACCTGGTGGTCCTTGGAGCCTTCTATGGGCAAGGGAGCAA
AGGCGGCATGATGTCAATCTTCCTCATGGGCTGCTACGACCCTGGCAGCCAGAAGTGGTGCACAGTCACC
AAGTGTGCAGGAGGCCATGATGATGCCACGCTTGCCCGCCTGCAGAATGAACTAGACATGGTGAAGATCA
GCAAGGACCCCAGCAAAATACCCAGCTGGTTGAAGGTCAACAAGATCTACTATCCTGACTTCATCGTCCC
AGACCCAAAGAAAGCTGCCGTGTGGGAGATCACAGGGGCTGAATTCTCCAAATCGGAGGCTCATACAGCT
GACGGGATCTCCATCCGATTCCCTCGCTGCACCCGAATCCGAGATGATAAGGACTGGAAATCTGCCACTA
ACCTTCCCCAACTCAAGGAACTGTACCAGTTGTCCAAGGAGAAGGCAGACTTCACTGTAGTGGCTGGAGA
TGAGGGGAGCTCCACTACAGGGGGTAGCAGTGAAGAGAATAAGGGTCCCTCAGGGTCTGCTGTGTCCCGC
AAGGCCCCCAGCAAGCCCTCAGCCAGTACCAAGAAAGCAGAAGGGAAGCTGAGTAACTCCAACAGCAAAG
ATGGCAACATGCAGACTGCAAAGCCTTCCGCTATGAAGGTGGGGAGAAGCTGGCCACAAAGTCTTCTCC
AGTGAAAGTAGGGGAGAAGCGGAAAGCTGCTGATGAGACGCTGTGCCAAACAAAGGTATTGCTGGACATC
TTCACTGGGGTGCGGCTTTACTTGCCACCCTCCACACCAGACTTCAGCCGTCTCAGACGCTACTTTGTGG
CATTCGACGGGGACCTGGTACAGGAATTTGATATGACTTCAGCCACGCACGTGCTGGGTAGCAGGGACAA
GAACCCTGCGGCCCAGCAGGTCTCCCCAGAGTGGATTTGGGCATGTATCCGGAAACGGAGACTGGTAGCT
CCCTGCTAGGTTTGCTGTCTTCCCTCTCCCTCAGGCCATACTCTCCTTTACCATACTACTGGACTGGACT
CAGGCTGGAGGCAGATAGACACAGTATAGGGGGAATGGGCTTGCTTCTCCCAAACCCACCAGTTCTCCAC
TGTCTCTTCTGGACCAGGAATTAGTTGCTGTGGGTGCCACAGCTGAAGTCAGTTTGTCTTGCTGGTTTAA
```

Figure 20 (Continued)

ATAGATCTTTCAGAGCTGGGTGCTGGGTTTGCCATCTTTTTGTTTTCTTTGAAAAGCAGCTTAGTTACCC
TTTTTATAAATAAAATATCTTGCAGTTATCTTTGTCCTTTCCCCACCTACACCCCCAATAATTTCCCTAG
AGATTAAGGAGTAAAGGCTGGGCTATGGCAGCTCTGTCCACAAAGCCTTCTCTCCCATCCTTGCCTGTTC
CTTTGTACTTCCAGGCTCATTTTAAAGTTGTATTTAAAGGACTGCCCTCGGAAATGCTTCTGTTTAGCGG
AACTTGTATTCAGCCTGACACGCTTTGCCAGGAACAAACCTCATGTGAAAGAAAACAAAATGAATTTTTT
TACTTTCTTCTC

>gi|33620720|ref|NM_014015.3| Homo sapiens Dexi homolog (mouse) (DEXI), mRNA
GCGCGAGGACCTGCGGGGCGGGCGGGAGAGAAGGCTGCCGGGACCGGCCCTAGACACTGAGCCGCGGTG
GGATCCCCACCGGCTCTGCGAGGCCCTGCGAGCGCCAGGGAGGCGCCACGAGGGAGCCGGGCAGCCGCGG
GCCACTTCAGGGGGCCCGCCTCGCCGCCCGGCGGTCGAGAGATCCTTGGGGGCACATCTCGGGGTGCG
GTGACCCGCCCGGCGCATTTCGGGGGTCGGGGCGCAATTGCCAGGGGACATCTGGAGCCCGGCCCTGCTT
CTGTCGGGCTCCAGGGTACCCCTGGATGGCTGCGCTGTGCCCTCGCCGGCCGCCCGGGCGCCGCAGCGGC
TGAGTTCGCCGGGATCGCCGGGCCGCCGCCCTTGCCACCCGCTGCATGCTCGGCGCCCGGGTCGCGGCCC
ACCTGGACGCACTGGGCCCCCTGGTCCCCTACGTGCCGCCGCCGCTGCTGCCCTCTATGTTCTACGTGGG
CCTGTTCTTCGTCAATGTGCTGATCCTGTACTACGCCTTCCTCATGGAGTACATCGTCCTCAACGTGGGC
CTCGTCTTCCTGCCCGAGGACATGGACCAGGCGCTCGTGGACCTCGGCGTGCTCTCCGACCCCGGCTCGG
GCCTTTACGATGCTGACTCGGAGCTCGACGTCTTTGATGCGTACTTGGAGTAGGGTCTCGACTGCTGTTC
CCCTCTTCCCTACACGATCCGCAACCCATGCCCTGGACCAGCCGCCCAGATCATGCCGCCGCAGCTGGTT
GGGGGCACCATCTGGACGGGATGGTTCCCCAGGAGGAGACCCTCCCCTGCCTCCGAGGCCTACCTGCTC
CCCTCAAAAGCTTCGTGCCAACAGAGAGGTTCCTGTTTGAACCCAGGAGAGTGGAAGAGAGATTGGGACT
GAGTGCTGAGGTTGGGAAGGCACCTGCTCCCACAGAAGGGGGAACGCAAGAGGCATCCCAAGACCTCATC
TGCCTGCAGTGTCAAATCGATGGCCTGGCCTTGGCTTCTGATTATTTGCAGCTGCGATGGATGTTTACAG
GAACCCAGCCAGAGTTTGCCTCCCTGCACTTCATCCCGGAGCGCACCTGCTTCCCCCACTTCACCTTCGG
AGAGGACACTTCAAACTGCGACACACGCAAAAGCGACTCCCAGCTCCGTTTGATGTGAGTTGAGCCTTC
AGGCCAGCTGGGTTTAGCCCGAGGCTGGTCTTAGATGCAGCGACTGTTTCAGGGGTGACTCAGAAGAAAA
AGAAGCTGAGGAAGCTGTTGGGGGGCTGAGGGTGGGATTCTCGCTCCTTCATTTCAGGTTACTCGTTCTT
CAGCAAGTTGGCAAAACAGACATCATGCTGGTGAGTGCCACGTTACTCCCCTGGCTGGAAATGCTTTTCT
GAAAGTATGAGTGTTGTGCCTACTTAATTCTGATAAACCTGTCTAAGCAATACTTAGGAGGCTTACTTCT
TTGGATTAAAAAAAAATGTATGCAACTCCAAAAAAAAAAAAAAAAAAAAAAAAAAAAAAAAAAAAAAAAA
AAAAAAAAAAAAAAAAAAAAAAAAAAAAAAAAAAAAA >gi|89145416|ref|NM_014033.3| Homo sapiens methyltransferase like 7A (METTL7A), mRNA
AGAAGGGGAAACAGGAATCGATTAGGAATAAAGGATTATAATCCACTTTCCTTCTGAGGAAAAGCTGGGA
ACCTTCTCATTTTGCCTTATGAAAACTAAGCTGAATCGACTGCTGCCAAACATCTATTAGGCAAAATTGG
CCTCTTGCCCATGATTTGACTTTCCAGCACAGCCAGTTCTTTTTCTCCTCTGCAGCTGATTGGCTCTGGA
GTGTGGCCAGAAGCCTCTCTCCTGCAATTAAAGGAGTCGGGTCTCTAACTGTTGATCTGTTTTTTTCCCT
TCTGAGCAATGGAGCTTACCATCTTTATCCTGAGACTGGCCATTTACATCCTGACATTTCCCTTGTACCT
GCTGAACTTTCTGGGCTTGTGGAGCTGGATATGCAAAAAATGGTTCCCCTACTTCTTGGTGAGGTTCACT
GTGATATACAACGAACAGATGGCAAGCAAGAAGCGGGAGCTCTTCAGTAACCTGCAGGAGTTTGCGGCC
CCTCCGGGAAACTCTCCCTGCTGGAAGTGGGCTGTGGCACGGGGCCAACTTCAAGTTCTACCCACCTGG

Figure 20 (Continued)

```
GTGCAGGGTGACCTGTATTGACCCCAACCCCAACTTTGAGAAGTTTTTGATCAAGAGCATTGCAGAGAAC
CGACACCTGCAGTTTGAGCGCTTTGTGGTAGCTGCCGGGGAGAACATGCACCAGGTGGCTGATGGCTCTG
TGGATGTGGTGGTCTGCACCCTGGTGCTGTGCTCTGTGAAGAACCAGGAGCGGATTCTCCGCGAGGTGTG
CAGAGTGCTGAGACCGGGAGGGGCTTTCTATTTCATGGAGCATGTGGCAGCTGAGTGTTCGACTTGGAAT
TACTTCTGGCAACAAGTCCTGGATCCTGCCTGGCACCTTCTGTTTGATGGGTGCAACCTGACCAGAGAGA
GCTGGAAGGCCCTGGAGCGGGCCAGCTTCTCTAAGCTGAAGCTGCAGCACATCCAGGCCCCACTGTCCTG
GGAGTTGGTGCGCCCTCATATCTATGGATATGCTGTGAAATAGTGTGAGCTGGCAGTTAAGAGCTGAATG
GCTCAAAGAATTTAAAGCTTCAGTTTTACATTTAAAATGCTAAGTGGGAGAAGAGAAACCTTTTTTTGG
GGGGCGGTTTTTTTGGTTTGTTGTTGGTTTTTTTTTTTTTTGGCGGGAAGAAAGAGTTTTGCTCTTGT
TGCCCAGGCTGGAGTGCAATGACGTGATCTCCGCTCACTGCAACCTCCACCTCGCGGGTTTAAGCGATTC
TTCTGCCTCAGCCTCCCTAGTAGCTGGGATTACAGGTGCCCACCACCATGCCCAGCTAATTTGTATTTTT
AGTTGAGACAGGGTTTCACTACGTTGGCCAGGCTGGTCTTGAACTCCTGATCTCAGGCAATCCACCCACC
TCAGCCTCCCAAAGTGCTGGGATGACAGGCGTGAGCAACCGCACCCAGCTTAAGGTTTTTTTGTTTTGTT
TTGAGACGGAGTTTTCGCTCTTGTTGCCCAGGCTGGAGTGCAATGCTGTGATCTCAGCTTACCACAACCT
CCACCTCCCGGGTTCAAGTGATTCACCTGCCTCAGCCTCCTGAGTAGCTGGTATTACAGGCATGCGTCAC
CACGCCGGCTAATTTTGTACTTTTAGTAGAGATGGTGTTTCCCCACGTTGGTCAGTCTGGTCTCAAATTC
CTGACCTCAGGTGATCTGCCTGCCTCGGCCTCCCAAAGTGCTGTGATTACAGACGTCAGCCACCATGCCT
GGCCTGAAACCTTTTTTAGGTAAAGTTGAATTCCATCCTTAAAAGTTTCTGTTATATCCTATTTAGCCAT
TTTCTATTGTCTCCCAAAGAATTCACATCAAAAAAACAGCTTTGAACTCCCCCTTCAAAGGAAACAGTCG
ACTTTCATAATTAGCATCTACCATTATCCCCAAATCTTATTTTATTCATTGACTTGAAATTTTTTCCAAT
TGCTTTTTTTTTTTTTTTTAAGGTTAAGAGCAGAGGTTTACTAGGCCAAAGAAAGAGAATAGCTCTCT
GTTGCAGAGAGGGGTCCTGGAGAAATGGGTTACCCCAGTTGTCTTATTTAAATGGTTACCCATCAGATTT
TAATTTTATCTTCTCTTTGAGAGCTTGGTAATAAGAAGCACTTAAATCACTCCAAAGAAGACTTTAAAAA
GGGAGCAGTGAAAAGGTCTTAATAATTTTATTGATTGAATTAAGAAATACTAGCTAATTAAGAATCTGAGT
CTAAACAGCACAGATTTTTTCTTTCTGCTTTTAAATTGTGTTTTAAAAAAAGAGACAGGGGCTGGGCGT
GGTGGCTCACGCCTGTAATCCTAGCACTTTGGGAGGCCGAGGCGGGTGGATCACGAGGTAGGAGTTAAAG
ACCAGCCTGGCCAACATGGCAAAACCCTACTAAAGATACAAAAAAAAAAAAAAATTAGCCAGGCGTGGTG
GTGGGTGCCTGTAATCCCAGGTACTTGGAAGGCTGAGGCAGGAGAATCTCTTGAACCCAGAAGGCGAAGG
TTGCAGTGAACCGAGATCATGCCATTGTACTCTAGCCTGGGTGACAAGAGCAAGACTCCGTCTCAAAAAA
AAAAAAAAAAAAAAAAGAAGTAGAGACAGGGAGACAGGGTCTCACTGTGTTGCCTAGGCCGGTCTTGAA
CTCCTGGGCTCAAGTGATTCTCCCACCTTGACCTCCTAAATTGTTGGGATTACAGGTGTGAGACAGTGCA
CCTGGCCGAAATAGCTCAAGTTTCTGAAAAACAAATCTGAATCTATTTGTTATTCTTAGCGTCACTGGTC
TGGCTTTCAGAATTAACATACAAGGTTGCCACACCTAGTTCTGCCCAGCTTTATGTCTTTTATTCCAGTA
TTCCACCAAAGTTTGTTTTCCTGCATTCCAGTTCTCAAGTCTTAAGATAAAGATTGTACTTGACAGTTTA
GTATATCCATAAAACTATTTGAGGTGGTTAAGGTTCTTGGGTTCATTTTCCTTAATACTTTGCTGAATAT
TGTAGATTGTAGGCAATGAAAAAGTCTACTAAATTAGGAAAACCTTGAATAATTAGGTATCCTAGGTAAG
AGCCCCTAAACATCAAGCAATCTGTGAGTCTGTAAAGAAATAAATATTTTTTGGATTATTCTTATCTAAT
TCCACCCCTGTTGGAAGATGATTTCTTTGTTCTTTGCAACTATGGAAGCTGTGAAAATCATCACAAGTGC
CTCTGAAAGCGAGTGTTAGGTTGGTTAGAGGGTTTAATATTTTCTGCAATGGTTTGTAGGAATTTTAATA
AATGTAGTATATTTTCTGAGATGATTTTGTAAAAGTACTATTTTAAATATCAAATCAACCAATAAATTCA
CATTTGTGTTAGGAACAGAAATATGGTTTA
```

Figure 20 (Continued)

```
>gi|196259810|ref|NM_014035.2| Homo sapiens sorting nexin 24 (SNX24), mRNA
AGGGCGCGGGAGCGGCCGGGTCAGCCCGCAGACCTGAGTCCGGCCCGCAGCCTCGGGGCCCCGCGGGCGC
AGCGGGGCGGGAGGCGGGGCGGCCCGGCCGTGGGCGGAGCGGCGGCCGCGGCCGTGAGCCTGCCCCCAAC
TCGCCCTCAGCCGGCTGGCCGGCGCGGCCATGGAGGTCTACATCCCGTCCTTTCGCTATGAAGAGAGCGA
CCTGGAGCGGGGATACACGGTGTTTAAGATAGAAGTGCTAATGAATGGAAGAAAACATTTTGTTGAAAAG
AGATACAGCGAATTTCATGCTTTGCACAAAAAGCTTAAGAAATGTATAAAAACTCCAGAAATCCCTTCTA
AACATGTTAGGAACTGGGTCCCCAAAGTCTTGGAACAGCGACGACAAGGCTTGGAAACATACTTACAGGC
TGTCATTTTAGAAAATGAAGAACTTCCCAAACTGTTTCTTGATTTCCTAAATGTGCGACACTTGCCCTCT
CTACCAAAGGCAGAAAGTTGTGGATCTTTTGATGAAACAGAGTCTGAAGAGTCAAGCAAACTGTCCCACC
AGCCTGTGCTGCTGTTCCTCAGGGATCCATATGTCTTGCCTGCAGCCAGCGATTTTCCAAATGTGGTTAT
TGAAGGAGTCCTCCATGGGATATTTTACCCTCATCTACAGCCCAGGTAGAAATCCTACATGGCTAAAAGA
AGCAGAAGCAAGTTTCGAAGTCACAGTCAAGGAAATCAATACCTACCAATTTAACCTAAACGCTATGATA
TATAACAGCTCTAGCTAGTGGTAAAGTGCACAGTCCCAGCTTAATTCAGGGCAGGGACATTTCCATTAGA
ATGGTGCTCTTAAAAATAGAAACTGAACCGGGGCGGTGGTCAGGCTAAGGCCAAGTGTTTAAGAAGTAGA
GTGTAGCTGCCAGCGTAGAAACCCATGAAAAGGAGGCCACAGGAGATTCCTGGGAGCACTGGGTGTAGCA
AAACAAAGCCACTCTCTGCTTCAGTCGCACCATTTGCTAATTGAAAATCATATCCTGAATCATACTGAGA
CTGATCAACTTTGGTAGCTTTTTTGTTCAGATCTTATGACACACTACTCTTCTCACCGTGAGATTTTCTC
AGCCAGTGATAGTACATTCTGAAATGCTGGCACCAGGAGACGGCCACAGACACACACTGCTAAATGTGAA
GATGGAACTAAACTGGAAATTAAATTATACTGACAATATTATGGCATTTTAAGATCATGGCATTTTAAT
TTACATTAGAGTGGAGTTGCATCATACTCAGGGGTTAGCTTCCAAGGTCAGTACATAGGTAAAATGGGCT
ATTAGGATGATCCTTGAAAGCCCTTTAGAAGGGTGCCATGTTGGAAACCTGTACATCCACAACAAGTAGC
TTTTCCTCCTATGTTGGAAAAAAAGACTGTTTCTTTGTTTGAAGACCAAGTGAAGTTGTTGGTGTTTGTT
TAGGGGCCATTTTGTTAAAAAAAAAAAAAAAAAAGCACATAACTTTTAACACTAGAATCAGCCCGCAAGA
TGCTTGCCCCGCTAGTGGCAGATGTGAACTGACAAGGAGTGAAGCGCCCACCCAGCGGATGGACAGCACC
CACCTGGGTTTACTCAAGGGTGTGCATTCATTTTAGGTGGGATCGCCACAGGATTTCATGTTATTTTCCT
TACGGCTTCCTTTTCACTGACCTCATTTGTTGAGTTAATGTAAGTTAAATGTGTTTATGATATAACTCCA
CTGTACATCATCCTTTGAGTAGTAAAGGATAAAAGCATATATACTACCTATATGTATGTGCTGTATGTGG
GCATTTCATTGAGATCTAATTAATAGCTAGCCTATTTATGGTTATTCGTTTTAGTAAGTTCTGTGGGAGC
AAGGTATTTAAAATCAAAACTAATAACTACATCATGGTTTTTGATTAGGATCTAAATATTCAGGTTTTAA
GCCTGCTGCAAACTTTTAAAATATTATGATAGATTCTGTACTACATGTGGGAAACAAGCAAGAACTAAAT
AATCAAATGTTGTCAACCAAAAGTAATAGTTGGGTATTGGAGATTTTTTAAAATGTTTTTATGTTATTA
GCTATTTGGAGTTAAATAAAAACAGAACAAGGAAACAAAA >gi|111607476|ref|NM_014042.2| Homo sapiens chromosome 11 open reading frame 51
(C11orf51), mRNA
GGGAGCGGGGAAAACAAAAGGAGACGAAGGACGCATGCGTTTGGTGAGTCCCGGATTCTGGTGGGTTCTT
CCGCTCAGGCTGGGTGAAGCGCTTCCGGGTCGCCGCCGGCAGCAGCCTCCCGGCGCGATGAAGACACTGA
GGCTCAGAGAGGTTAAGTGACTCAGCCAAGGTCAAACAGCTAGTAAGTGGTGGAGCCAGGACTCAAAGCC
AGTCTAGGAGCCATGTCCACTTTGTTCCCCTCACTCTTCCCTCGTGTGACTGAGACTCTGTGGTTTAATC
TGGATCGACCCTGTGTGGAAGAGACAGAGCTGCAGCAGCAGGAACAGCAGCATCAGGCCTGGCTCCAAAG
CATCGCGGAGAAAGACAACAACCTGGTTCCTATTGGCAAGCCAGCCTCAGAGCACTATGATGACGAGGAA
GAAGAGGATGATGAAGATGATGAGGATAGTGAAGAGGACTCAGAGGATGATGAGGATATGCAGGACATGG
```

Figure 20 (Continued)

```
ACGAGATGAATGACTACAATGAGTCACCGGATGATGGAGAGGTCAATGAGGTGGACATGGAAGGCAACGA
ACAGGATCAGGACCAGTGGATGATCTAGGTAGACAAGGCAGGGTGGCCTCAGGGAGATTCCAGGCCAGCC
CAAACTACCCTGCATCCCAACCCCCAACCCCTGCCCACAGAACCAGCTGATGGCCCCAGTGCCTGAAAGT
GCCCTTGGGCACCTCCTCAGCTGCTGCCAGGATCTGGTCTCTTTGGCCCCTCCCAGGCCATCAGTCTGCA
CTTGAAATCCCCAGGGCCTGAAACCTACTCCACCTTCCTGGCCAGTACCTCACCCCTTGATTGCCAGGTC
TGGTCTAAGTTTCTTTAATAAAGACAAAGGAGTGATTTTCCA

>gi|58530882|ref|NM_014045.3| Homo sapiens low density lipoprotein receptor-
related protein 10 (LRP10), mRNA
CTACTCCAACCCCTGGGCGGGCGGGGGTACCGCCTGGGCAAGGGCCGGGGCGCCGGGCCGAGCCACCTCT
TCCCCTCCCCCGCTTCCCTGTCGCGCTCCGCTGGCTGGACGCGCTGGAGGAGTGGAGCAGCACCCGGCCG
GCCCTGGGGGCTGACAGTCGGCAAAGTTTGGCCCGAAGAGGAAGTGGTCTCAAACCCCGGCAGGTGGCGA
CCAGGCCAGACCAGGGGCGCTCGCTGCCTGCGGGCGGGCTGTAGGCGAGGGCGCGCCCCAGTGCCGAGAC
CCGGGGCTTCAGGAGCCGGCCCCGGGAGAGAAGAGTGCGGCGGCGGACGGAGAAAACAACTCCAAAGTTG
GCGAAAGGCACCGCCCCTACTCCCGGGCTGCCGCCGCCTCCCCGCCCCCAGCCCTGGCATCCAGAGTACG
GGTCGAGCCCGGGCCATGGAGCCCCCTGGGGAGGCGGCACCAGGGAGCCTGGGCGCCCGGGGCTCCGCC
GCGACCCCATCGGGTAGACCACAGAAGCTCCGGGACCCTTCCGGCACCTCTGGACAGCCCAGGATGCTGT
TGGCCACCCTCCTCCTCCTCCTCCTTGGAGGCGCTCTGGCCCATCCAGACCGGATTATTTTTCCAAATCA
TGCTTGTGAGGACCCCCCAGCAGTGCTCTTAGAAGTGCAGGGCACCTTACAGAGGCCCCTGGTCCGGGAC
AGCCGCACCTCCCCTGCCAACTGCACCTGGCTCATCCTGGGCAGCAAGGAACAGACTGTCACCATCAGGT
TCCAGAAGCTACACCTGGCCTGTGGCTCAGAGCGCTTAACCCTACGCTCCCCTCTCCAGCCACTGATCTC
CCTGTGTGAGGCACCTCCCAGCCCTCTGCAGCTGCCCGGGGGCAACGTCACCATCACTTACAGCTATGCT
GGGGCCAGAGCACCCATGGGCCAGGGCTTCCTGCTCTCCTACAGCCAAGATTGGCTGATGTGCCTGCAGG
AAGAGTTTCAGTGCCTGAACCACCGCTGTGTATCTGCTGTCCAGCGCTGTGATGGGGTTGATGCCTGTGG
CGATGGCTCTGATGAAGCAGGTTGCAGCTCAGACCCCTTCCCTGGCCTGACCCCAAGACCCGTCCCCTCC
CTGCCTTGCAATGTCACCTTGGAGGACTTCTATGGGGTCTTCTCCTCTCCTGGATATACACACCTAGCCT
CAGTCTCCCACCCCCAGTCCTGCCATTGGCTGCTGGACCCCCATGATGGCCGGCGGCTGGCCGTGCGCTT
CACAGCCCTGGACTTGGGCTTTGGAGATGCAGTGCATGTGTATGACGGCCCTGGGCCCCCTGAGAGCTCC
CGACTACTGCGTAGTCTCACCCACTTCAGCAATGGCAAGGCTGTCACTGTGGAGACACTGTCTGGCCAGG
CTGTTGTGTCCTACCACACAGTTGCTTGGAGCAATGGTCGTGGCTTCAATGCCACCTACCATGTGCGGGG
CTATTGCTTGCCTTGGGACAGACCCTGTGGCTTAGGCTCTGGCCTGGGAGCTGGCGAAGGCCTAGGTGAG
CGCTGCTACAGTGAGGCACAGCGCTGTGACGGCTCATGGGACTGTGCTGACGGCACAGATGAGGAGGACT
GCCCAGGCTGCCCACCTGGACACTTCCCCTGTGGGCTGCTGGCACCTCTGGTGCCACAGCCTGCTACCT
GCCTGCTGACCGCTGCAACTACCAGACTTTCTGTGCTGATGGAGCAGATGAGAGACGCTGTCGGCATTGC
CAGCCTGGCAATTTCCGATGCCGGGACGAGAAGTGCGTGTATGAGACGTGGGTGTGCGATGGGCAGCCAG
ACTGTGCGGACGGCAGTGATGAGTGGGACTGCTCCTATGTTCTGCCCCGCAAGGTCATTACAGCTGCAGT
CATTGGCAGCCTAGTGTGCGGCCTGCTCCTGGTCATCGCCCTGGGCTGCACCTGCAAGCTCTATGCCATT
CGCACCCAGGAGTACAGCATCTTTGCCCCCCTCTCCCGGATGGAGGCTGAGATTGTGCAGCAGCAGGCAC
CCCCTTCCTACGGGCAGCTCATTGCCCAGGGTGCCATCCCACCTGTAGAAGACTTTCCTACAGAGAATCC
TAATGATAACTCAGTGCTGGGCAACCTGCGTTCTCTGCTACAGATCTTACGCCAGGATATGACTCCAGGA
GGTGGCCCAGGTGCCCGCCGTCGTCAGCGGGGCCGCTTGATGCGACGCCTGGTACGCCGTCTCCGCCGCT
GGGGCTTGCTCCCTCGAACCAACACCCCGGCTCGGGCCTCTGAGGCCAGATCCCAGGTCACACCTTCTGC
```

Figure 20 (Continued)

```
TGCTCCCCTTGAGGCCCTAGATGGTGGCACAGGTCCAGCCCGTGAGGGCGGGGCAGTGGGTGGGCAAGAT
GGGGAGCAGGCACCCCCACTGCCCATCAAGGCTCCCCTCCCATCTGCTAGCACGTCTCCAGCCCCCACTA
CTGTCCCTGAAGCCCCAGGGCCACTGCCCTCACTGCCCCTAGAGCCATCACTATTGTCTGGAGTGGTGCA
GGCCCTGCGAGGCCGCCTGTTGCCCAGCCTGGGGCCCCCAGGACCAACCCGGAGCCCCCCTGGACCCCAC
ACAGCAGTCCTGGCCCTGGAAGATGAGGACGATGTGCTACTGGTGCCACTGGCTGAGCCGGGGTGTGGG
TAGCTGAGGCAGAGGATGAGCCACTGCTTACCTGAGGGGACCTGGGGGCTCTACTGAGGCCTCTCCCCTG
GGGGCTCTACTCATAGTGGCACAACCTTTTAGAGGTGGGTCAGCCTCCCCTCCACCACTTCCTTCCCTGT
CCCTGGATTTCAGGGACTTGGTGGGCCTCCCGTTGACCCTATGTAGCTGCTATAAAGTTAAGTGTCCCTC
AGGCAGGGAGAGGGCTCACAGAGTCTCCTCTGTACGTGGCCATGGCCAGACACCCCAGTCCCTTCACCAC
CACCTGCTCCCACGCCACCACCATTTGGGTGGCTGTTTTTAAAAAGTAAAGTTCTTAGAGGATCATAGG
TCTGGACACTCCATCCTTGCCAAACCTCTACCCAAAAGTGGCCTTAAGCACCGGAATGCCAATTAACTAG
AGACCCTCCAGCCCCCAAGGGGAGGATTTGGGCAGAACCTGAGGTTTTGCCATCCACAATCCCTCCTACA
GGGCCTGGCTCACAAAAAGAGTGCAACAAATGCTTCTATTCCATAGCTACGGCATTGCTCAGTAAGTTGA
GGTCAAAAATAAAGGAATCATACATCTCAAAA

>gi|315113846|ref|NM_014110.4| Homo sapiens protein phosphatase 1, regulatory
subunit 8 (PPP1R8), transcript variant 1, mRNA
GTACGCACAGGCTGCTGGGATGCCGCTTTTCCCTTCTCGGTCTTCCAGTTTCCCGGCGTGCTTAGGGCGC
GCCAAATGGGAGGGGGAGACGCAAGATGGCGGCAGCCGCGAACTCCGGCTCTAGCCTCCCGCTGTTCGAC
TGCCCAACCTGGGCAGGTAAGCCCCCTCCCGGTTTACATCTGGATGTAGTCAAAGGAGACAAACTAATTG
AGAAACTGATTATTGATGAGAAGAAGTATTACTTATTTGGGAGAAACCCTGATTTGTGTGACTTTACCAT
TGACCACCAGTCTTGCTCTCGGGTCCATGCTGCACTTGTCTACCACAAGCATCTGAAGAGAGTTTTCCTG
ATAGATCTCAACAGTACACACGGCACTTTCTTGGGTCACATTCGGTTGGAACCTCACAAGCCTCAGCAAA
TTCCCATCGATTCCACGGTCTCATTTGGCGCATCCACAAGGGCATACACTCTGCGCGAGAAGCCTCAGAC
ATTGCCATCGGCTGTGAAAGGAGATGAGAAGATGGGTGGAGAGGATGATGAACTCAAGGGCTTACTGGGG
CTTCCAGAGGAGGAAACTGAGCTTGATAACCTGACAGAGTTCAACACTGCCCACAACAAGCGGATTTCTA
CCCTTACCATTGAGGAGGGAAATCTGGACATTCAAAGACCAAAGAGGAAGAGGAAGAACTCACGGGTGAC
ATTCAGTGAGGATGATGAGATCATCAACCCAGAGGATGTGGATCCCTCAGTTGGTCGATTCAGGAACATG
GTGCAAACTGCAGTGGTCCCAGTCAAGAAGAAGCGTGTGGAGGGCCCTGGCTCCCTGGGCCTGGAGGAAT
CAGGGAGCAGGCGCATGCAGAACTTTGCCTTCAGCGGAGGACTCTACGGGGCCTGCCCCCCACACACAG
TGAAGCAGGCTCCCAGCCACATGGCATCCATGGGACAGCACTCATCGGTGGCTTGCCCATGCCATACCCA
AACCTTGCCCCTGATGTGGACTTGACTCCTGTTGTGCCGTCAGCAGTGAACATGAACCCTGCACCAAACC
CTGCAGTCTATAACCCTGAAGCTGTAAATGAACCCAAGAAGAAGAAATATGCAAAAGAGGCTTGGCCAGG
CAAGAAGCCCACACCTTCCTTGCTGATTTGATATTTTTGGTCATGGAGAAGGGTGGGATTGGGTGGGAAT
GGGGTGGAAGGGTGATGGGGAGCTAATGAACTAGGGAGAAAAACTTTCCATGTGTGCGGTATCGTCTTTC
AGAATGTCTCCTGGCATCCTAACCATGTAATATGACAATTGGGGGTGGGGTTGAAATAGCCCATAAAGAC
CTGTCTTCACAACACTTGCATTGTAGAGAAAGGCTTCTTATATCCTTTTCAATAGACTGCCCTGGCTCTT
TCCTAGGCCTTCCACTACCTCCTTTCTTTCTCCCACTTTCTAGGATCATTTTTATGTAAAGTCACATATC
CCAGGCCCTCAGGTTGAATCCAGAGCTGTAGAGGTTACAGTAGCATCACCAGCCTTGGGGGTCCAGAGCC
TAATTTATATTCACTATCCTTCCAAGTCCCGGGTAGCAGAAGGGTTGCCATAGATCTCAGTTTGATCAAA
AAGAAGGCTTAGAATTCTGCAGTTAAGCTGAGGTTTAAACTAAAAAATGTTTCCTTGGGTCAGTGGTTTT
GAGGTCCAGTAGCTAGGCTTTTCTCTTTTGTCCTTCCTGTTGGAATGAAAACATTTCGATTTTCCTTCAT
```

Figure 20 (Continued)

```
CTGTGACTGGTGCCATAGACACAGGTTTATAGTTTTAACTTACAGTATTGTTTGAAATTTACCTGTTTTT
CTTGTCAAACCTGAGCACTCCTCCTGCTGAAGTTTCTTATTTAATTCCAGAGTACTGTCCTCTACTCTAA
GGCATTACTTTTAAGTGTATTATGAAGGCAGTTTTCAAAGGATATGACCAGTTGGGGTAATTCAAATTAA
AAAGGAAAAGATTTGTTTGGAAGTAACTGGTGTCTCTAAGAGGAATTTTTAGATGTCAGTTTGGAGGCTC
TTTCCCCCCTCAATTGAGAGCTCTTGTTATTCAGAGCTCCAAGACTAGACCTGGCTAACAAACATAGGAG
ACAAAGTTAGGAAACATTGATACAAGCTTTGTACAGAGATTTGTACATTTGTGTAATAGGCCTTTTCATG
CTTTATGTGTAGCTTTTTACCTGTAACCTTTATTACATTGTAAATTAAACGTAACTTTTGTCATTTGGGT
GCAGGCTGTGAATTTGTCTCTCAGTCACTGATTGCCACTGCCATCTGGAAATGTTTGCTAAAGGCACAGT
CACTGGGCTTGGGAGGCAATGCTCCATCCCCATTATATTACAAATAAAGATGCCCTAAATGAGTGTG

>gi|142370068|ref|NM_014184.2| Homo sapiens cornichon homolog 4 (Drosophila)
(CNIH4), mRNA
GACGGAAGGAGCGGCGGCGACGGAGGAGGAGGATGGAGGCGGTGGTGTTCGTCTTCTCTCTCCTCGATTG
TTGCGCGCTCATCTTCCTCTCGGTCTACTTCATAATTACATTGTCTGATTTAGAATGTGATTACATTAAT
GCTAGATCATGTTGCTCAAAATTAAACAAGTGGGTAATTCCAGAATTGATTGGCCATACCATTGTCACTG
TATTACTGCTCATGTCATTGCACTGGTTCATCTTCCTTCTCAACTTACCTGTTGCCACTTGGAATATATA
TCGATACATTATGGTGCCGAGTGGTAACATGGGAGTGTTTGATCCAACAGAAATACACAATCGAGGGCAG
CTGAAGTCACACATGAAAGAAGCCATGATCAAGCTTGGTTTCCACTTGCTCTGCTTCTTCATGTATCTTT
ATAGTATGATCTTAGCTTTGATAAATGACTGAAGCTGGAGAAGCCGTGGTTGAAGTCAGCCTACACTACA
GTGCACAGTTGAGGAGCCAGAGACTTCTTAAATCATCCTTAGAACCGTGACCATAGCAGTATATATTTTC
CTCTTGGAACAAAAAACTATTTTTGCTGTATTTTTACCATATAAAGTATTTAAAAAACAGGAAAAAAAAA
AAAAAAAAAAAAAAAAAAAAA >gi|342672051|ref|NM_014303.3| Homo sapiens pescadillo homolog 1, containing BRCT
domain (zebrafish) (PES1), transcript variant 1, mRNA
AGACAGCGTGGGGTGGGGAGGGTCCTCGGGGTCCTTGGCAGGGCACGTGCGGGAGGAAGTGGAGCTCCCT
GTACGCGCGGCCCTAGTCGGCTCCTCAACGTGGAGCGATGGGAGGCCTTGAGAAGAAGAAGTATGAACGA
GGCTCGGCCACCAACTACATCACCCGGAACAAAGCCCGGAAGAAGCTCCAGCTGAGCTTGGCTGACTTTA
GGCGGCTGTGCATTCTGAAGGGCATTTATCCCCATGAACCCAAACACAAGAAGAAGGTTAACAAGGGTTC
TACAGCAGCCCGAACGTTTTACCTTATCAAAGACATCAGGTTTCTCCTCCACGAACCCATTGTCAACAAG
TTCCGTGAATACAAGGTGTTCGTCCGGAAGCTCCGGAAGGCTTATGGGAAGAGCGAGTGGAACACTGTAG
AGCGTTTAAAGGACAATAAGCCCAACTACAAACTCGACCACATCATCAAGGAACGGTATCCCACGTTCAT
CGATGCCCTGCGGGACCTGGACGATGCCCTCTCCATGTGCTTCCTGTTTTCCACCTTCCCGCGGACTGGC
AAGTGCCACGTGCAGACCATTCAGCTGTGCCGCCGGCTCACTGTGGAGTTCATGCACTACATTATCGCTG
CCCGTGCCCTGCGCAAGGTCTTCCTGTCCATCAAAGGCATTTACTACCAGGCCGAGGTACTGGGCAGCC
CATCGTGTGGATCACTCCCTATGCCTTCTCCCATGACCACCCGACAGACGTGGACTACAGGGTCATGGCC
ACCTTCACCGAGTTCTACACCACGCTGCTGGGCTTTGTCAACTTCCGCCTTTACCAGTTGCTCAACCTCC
ACTATCCCCCGAAGCTCGAGGGTCAGGCCCAAGCAGAGGCAAAGGCCGGTGAGGGCACCTACGCGTTGGA
CTCCGAGAGTTGTATGGAGAAACTGGCAGCCCTCAGTGCCAGCCTGGCCCGCGTGGTGGTGCCTGCCACA
GAGGAGGAGGCCGAGGTGGATGAGTTTCCCACCGATGGGGAGATGTCAGCGCAGGAGGAAGACCGCAGGA
AGGAGCTGGAGGCGCAGGAGAAGCACAAGAAGCTTTTTGAGGGCCTGAAGTTCTTCCTGAACCGAGAGGT
GCCCCGTGAGGCCCTGGCCTTCATCATCAGGAGTTTTGGTGGGAAGTGTCCTGGGACAAATCTTTGTGC
```

Figure 20 (Continued)

```
ATTGGGGCCACCTATGACGTCACAGACTCCCGCATCACCCATCAGATTGTCGACCGGCCTGGGCAGCAGA
CCTCAGTCATTGGCAGGTGCTACGTGCAGCCCCAGTGGGTGTTTGACTCAGTGAACGCCAGGCTCCTTCT
CCCCGTGGCAGAGTACTTCTCTGGGGTGCAGCTGCCCCCACACCTTTCACCCTTTGTGACCGAGAAGGAA
GGAGATTACGTTCCACCTGAGAAGCTGAAGCTGCTGGCTCTGCAGCGGGGAGAGGACCCAGGAAACCTGA
ATGAGTCAGAAGAGGAGGAGGAAGAGGACGACAACAACGAAGGTGATGGTGATGAAGAGGGAGAAAATGA
GGAGGAGGAGGAAGATGCAGAGGCTGGTTCAGAAAAGGAGGAAGAGGCCCGGCTGGCAGCCCTGGAAGAG
CAGAGGATGGAGGGGAAGAAGCCCAGGGTGATGGCAGGCACCTTGAAGCTGGAGGATAAGCAGCGGCTGG
CCCAGGAGGAGGAGAGTGAGGCCAAGCGCCTGGCCATTATGATGATGAAGAAGCGGGAGAAGTACCTGTA
CCAGAAGATCATGTTTGGCAAGAGGCGAAAAATCCGAGAGGCCAACAAGCTGGCGGAGAAGCGGAAAGCC
CACGATGAGGCGGTGAGGTCTGAGAAGAAGGCCAAGAAGGCAAGGCCGGAGTGAGTGCCTGCGGCCCCTC
ACAGGGCTGAGGCCAGCCCCTAGCAGCTGGATGTGGCAGAGGCAGGCCAGAGGACCTAAGTGTGATGGAC
CAGAGTCACTTCTCCTCCTCCTTTCTCCAGCCAGCCCTGACCCCTCATGCTCTCTGGCTGGGCCAGTGGG
CAGCCCTCGCTTCCCTTGGATGGAGCTGCCCTGCTGGTGCCTGGTCAGAGAAGAGGCCTCTGTGCCCAGC
CTGATTCTCTGCTCCCAGGAGCCAGTGACATGAGGTGCAGAGGCCCACCCAGCCCCCTACCTACTGCCCC
CATTCATCCTGGCTTTCCACAGCCCCCTCCCACACAGTTGGACCCGTGATTCTCAGGGTGCTGTGATGGG
GTGAGGGTAGGGGAGCATTTGTTATTAAATGACTGGACTTTTGTGCCAATTGCAAAAAAAAAAAAAAAA
AA
```

>gi|34222308|ref|NM_014408.3| Homo sapiens trafficking protein particle complex 3 (TRAPPC3), mRNA
```
GCTGAGGGGCAGCGGCTTAGGCTCCGGCGTCTGCAGGGGTCGCCGAGCTAACCCGTGGCTAGGCGAGTGG
GGCGGGGCGGCCGGCACCATGTCGAGGCAGGCGAACCGTGGCACCGAGAGCAAGAAAATGAGCTCTGAGC
TCTTCACCCTGACCTATGGTGCCCTGGTCACCCAGCTATGTAAGGACTATGAAAATGATGAAGATGTGAA
TAAACAGCTGGACAAAATGGGCTTTAACATTGGAGTCCGGCTGATTGAAGATTTCTTGGCTCGGTCAAAT
GTTGGGAGGTGCCATGACTTTCGGGAAACTGCGGATGTCATTGCCAAGGTGGCGTTCAAGATGTACTTGG
GCATCACTCCAAGCATTACTAATTGGAGCCCAGCTGGTGATGAATTCTCCCTCATTTTGGAAAATAACCC
CTTGGTGGACTTTGTGGAACTTCCTGATAACCACTCATCCCTTATTTATTCCAATCTCTTGTGTGGGGTG
TTGCGGGGAGCTTTGGAGATGGTCCAGATGGCTGTGGAGGCCAAGTTTGTCCAGGACACCCTGAAAGGAG
ACGGTGTGACAGAAATCCGGATGAGATTCATCAGGCGGATTGAGGACAATCTTCCAGCTGGAGAGGAATA
ACCATCCCTACAACTCGAGGATAGCCATCAGGAGCACTGTTGGAATCAGCAGGCCTCTGTGCTCCCTCTG
CCCTCCAGAACTCAGTGACTCTTGAACATGGATGTTATATATTCTTATAACCTGTTTCCATTCTCCATTC
AAATAAAGAGCAGACTGCGATATAGTCCATTTACCCCATGTGTGCACATTCAGGAGCGACAGTCTCTGCC
CCCATTCCCTTGAGAGGGCTGGATGTAATCACCTTTGGTTGGACTAGAAAGAGCTCAAACCATTTTACA
TTCCTGTTTGAATTTTTCCAAAGCAAAACTCACTTTGACCCCATTAAGAGGCAAGCCTGGCACATCTATC
CCTGGGCCTTTAGAAAGCCATTTGCCTCAAATGGCTATAGGGTTGTGGGGTGGAGGGAGGAAGGGCTGGG
AGGGAGTGGGGAGGAATTGCTAGCTGTAGTGTGACACATTGTAGTGTTTGCCAGGAAAGGAGCCAGTCAT
GCCGGAAACACTGACTTCTGGGAAGCCACCCAGGTCTCATTCCTCCCTGCTGTTGGAGGCAACATCTCCT
CTTTTTACAGAGGGTACATCCTTTTTTCTTACAAATTCTTCAATAAAGACACATTCTTGAGTGAAATCCC
AAAAAAAAAAAAAAAAAA
```

>gi|218931146|ref|NM_014548.3| Homo sapiens tropomodulin 2 (neuronal) (TMOD2), transcript variant 1, mRNA

Figure 20 (Continued)

```
GCGCGCCCCGGCGCCGCGCCCGGCCGGGAGCCGCCTGTTGATCGCCGCGCTCGCCCCGGCCACGGCGCCG
CCCCTGTTCTCCCGGCCCCGCTCCACCGGGGCTGACGGACTGACGGCCAGCACAGCCGGCTCCGGGATGA
GCGCACGGACGGTATTCTGAAGTCTCAGGAAACTGGACCATTTAAATGTGCATGGCCCATGAGAAAGGCT
TATAAGAAGCCATGGCACTCCCCTTTCAAAAAGAGCTGGAGAAATACAAGAACATTGATGAAGATGAGCT
TCTTGGCAAACTCTCAGAAGAGGAACTGAAACAGTTGGAAAATGTTCTAGATGACCTAGATCCTGAGAGT
GCCATGCTGCCAGCTGGATTTCGACAGAAAGACCAGACACAGAAGGCAGCCACCGGCCCCTTTGACCGCG
AGCACCTCCTCATGTACCTGGAGAAGGAGGCTTTGGAACAGAAAGACAGAGAGGACTTTGTGCCCTTCAC
TGGAGAAAAGAAAGGGAGAGTCTTTATCCCTAAAGAAAAGCCTATAGAAACTCGTAAAGAAGAAAAAGTG
ACCCTTGACCCAGAACTGGAAGAAGCTTTGGCCAGTGCCTCTGACACCGAACTCTATGATCTTGCAGCTG
TCCTTGGAGTACACAATTTGCTCAACAATCCAAAGTTCGATGAAGAAACAGCCAACAATAAAGGTGGCAA
AGGACCTGTCAGAAATGTTGTCAAAGGTGAAAAAGTAAAGCCAGTATTTGAGGAACCACCAAATCCCACA
AATGTGGAAATAAGCCTGCAGCAGATGAAAGCCAATGATCCTAGCTTGCAAGAAGTCAACCTCAACAACA
TTAAGAACATTCCAATTCCAACCCTGAGGGAATTTGCAAAGGCTCTGGAGACCAACACTCACGTGAAGAA
GTTCAGCCTGGCCGCAACTCGCAGCAATGACCCTGTGGCCATTGCTTTTGCAGACATGCTGAAAGTAAAC
AAGACCTTGACAAGTCTAAACATAGAATCCAATTTTATCACTGGAACTGGGATCCTGGCCCTGGTAGAGG
CACTGAAAGAAAATGACACCTTGACAGAAATCAAGATTGACAACCAGAGGCAGCAGTTGGGAACAGCTGT
AGAGATGGAAATTGCCCAGATGCTGGAGGAGAATTCAAGGATCCTCAAGTTTGGATACCAGTTTACCAAG
CAAGGGCCACGAACAAGGGTGGCAGCTGCCATCACAAAGAATAATGACCTGGTTCGTAAGAAGAGAGTTG
AAGCAGACCGAAGGTAAACTTCCTTGAGGAGAAGTGAAGTTTCACTGTGGTATGGCCATTGAAAACAAA
AACTCTTCTTCTTCCCCATCAGGACCATTTTATCAAAGTTCGTTCATTTCCGTTAACCACATAACTAATA
ATTTAATTGTTATTCTTTTTTAGCACTACTTATTTATCTTGGATTTTGTAATATATGCAATTGTTTTATT
TGCTCATGGGCACTTCTGGCAACTTGACAAATGGACCGATGCAGATTTTAGAGAGTGACGACATGGAAAA
TGAATTTAACCACTTTCTTATTGGGTTGTCTTGCTTTCTTACATGAACTTGTTTTTTTAATCACTGAAAG
GAATTTAGTGTATAATATGTGTTTGTAACTGTGATTATGATAGAGGCCTATCTCTGTTTACATGCATAGC
TTTGAGTTAGGCTAAATACATCAGAAGTGTTCTACTGACCACATAAGAAGTTAGTATTGCCAATCTTTCA
CTGCATGTGAAAATGTGACCAATTTAGCACAAATTCTCTCTTAGTTCCAGAAAAATCAGTAAATGCACAT
GCCCTGTTGATTGGAGATCAGTAGTGTCATCTTCATAAAGCAAGACAACATTATGACACTTTAAAACAGT
AGCAAAGAAGTCTATTTATTAACCCACAAATGTAGCATCAAGCCAGACTCACAGGTAGCAAAATGAATTA
CACACCTACTTTTACTGACTATTCAACATAAATTGAATCTTTAACATGACTTTAAAGGCTATTTACAAAG
CTGTTTTAAAGTTTTTCAAACATGATAGAAATTTTCTAAATTTTAGTAAGAGAGAAGCTTTTAAAACAGT
ACATTCCTGAATAAAACAACAATATTGTATCTTAATCAAGGCTGTCTGATGCAGATGATTGCATTTTTTG
GCAAATTTTAGAAGCATTTATTGCTTTGTCTTTAGTGTAACAAGATCACTGGATTAAATATAAACATTCA
GGTTAATTATCTAGATTTTGTCCACAGTATATGATCCATCCAGACATTTGCAAACGTCAGGAGAAAAAT
GTGAATTATTTATCCAGATGCATGTCATCTCAAGGACAAAGCCTGTGAAAGTACAAGTGAGATGGTTGCA
TTGTAGTATGCATTAATCTTTCAATGTAGTGGTGTAAAAATGCAGTGCTAAACTAATGAAGCAGGTGACT
GCAGCCTTTGGCTCAAGCTCACAACTCTGATAACTGTCAGTGCCTGAGGTTGTGATTGGTGACATTCTGA
CACTGCCCAAGGCAACTCACCCTCTATTCCTCCTTTCTCCCCTCCCTTCTTCCAATTCATTGTCTTTTT
TTTCCTCTTTTCTCTGTAATTTGTTACTAAACAAATTCCAGAATTTGTTTAGTAGCTGAGTGTTCCTGAG
TTGCCTAGTAGCAATAAAACAAGTGAATAGGAAAATAATTAATATATTATTCTATTTAGCTTGTAAAACA
CATGGAATCTGTTTAAGATAGCCCTTGTAAAATTGAACATTTACCTGTATTGTAAGTACCCACATCTGTG
TCTCTGAAGTCCTTTGAAACATCTCATTATCTTGAAATTTTTTAATGTTTGAGAACACCATAAGCAGAA
TATTCTAACACCTTTGGCCCCTGAAAATCCTTTAATTAGTTTATGGCTTCATCTCCTTATCTATTTAAAA
```

Figure 20 (Continued)

```
AACATAGTAAATAATGTTTATGGTTTTCAGTCTGATTTTTCCTTCCCTTTCACCCATTTAGGTGTGATGT
GTTGGAGTCAACTTGTACAGGCTTGCCAACTGTTATATTTTCAAGAATTTTGCAAACTGGTTGTTCAATA
CAGCCATTATTTAAAATTAAATGATGTGCACTTACAACTGAATGAATTATATTAAGGACAGAAGTAACAA
ATACTGTACTCAAAAATCTTACATTTTACTATTTTCTAACCTCTTAGATTATTTACATCTAGTAGGTATG
TATGTAGAAATATTACCAAACAGTATGCTACTGAACGTATCCTCTCAACTCCATGTTCACTACCTTCTTG
TTACTACAGTGGCTTGAAATTGGCCATGGTAGAAATATTTACACCACAGAAATTAGCAATATGTAAGAAA
TTGGGGTTTTCTCCCTCTCCAGATTGCTGGTTGATAAACATTCATCAGCACACCACTGGGTGAAATTATA
CATTTTTTATACATATGTTTCGCTTATCATGTTGCCGAAGGGAAGAACATTTCTCTTAGATGTCTTTTC
TCCTCTTTGGATTTGTTACAAACCTGTTTAAGTGCTGAGTCCCTGACCTGCCTCTCCAAGTAAGCCTTTT
TCCTTTTTTTTTTTTTTTTCTTACTCTCATTCTTGCCTTGACTCTTAAAATCCTGGACCCTATAGAGCA
TTCCTTGCAGCCCCACAGTGCTGTGGGCTGGGGGCTAAAGCAGTTCTTGGCAAACTCTGGCAGAAAGCAA
GAAAAAAAGAATCAGAATTCAATCATGGCTGTTTCTTTTGTACAAGCAGTTGTTGATAGTATTAAAGCAA
GATAATGGGACATTATCAAAAATATAGCACTGTTTTTACCTTATGAAATAGTTGGGTTGCATGCAACAGA
GTCTATGAAATCAAATGTTTTTTACTAATCAGTTTGTTTTCTTATTACCTGTGTTTTTAAAGTGGCTTGA
AAGGTGGCATTTCCATGAGTGTGCACATATTGATGATAACCCTTAGAAAAACATACACTTGAGGAGCCTA
TCCATCATTTAATTAGCCTAGGACTTCATCTCCCTCTCTGCCCAAAGTGTGGAAGTGGTAGCTCTTTCAT
GATCATGGGCACAGTTAATCCTTTGCTATCCATTGTGATGGGGCATAATGTATATAAAATATTTTTCTAT
GTATTTGTTCTGCCAGATACTGTGTTGAGATATTTGGCAATATCTGGATAACTGACTGAAGGGAGATAAC
TTCTCCCCAGGCCTATCTCCCTCCCCCTTTTAGAGTTGTGCAGGTCCACTTTAAGTGTAAAATCACTCAC
CTGGACTTGTGGGCTTGTATCACCAACATCTATTATGGCACATGTAGATGACATTTAGGAGAAAAACCTT
AGAAGTCTAGAAATCATATGATTAGTTCAGCACTGCAGCTCCCCATCTGCTTATAGTGTATAACTGGAAG
CTCTTTCATCCTCATCAGCATGATTAAATGACTTCGTTTCTTTCATCTTTGGAGGGTATAATGTAAATAA
GTGTCGTGTGTGTATGTGTGTGTGTACTGTCAGATATCTAACTAGGTATTTGGCTACATCTGGACAACTG
ATTGAAGGGAGATGCTCTCTCCCCAGTCCTCTTCCCTTGTCCTTTTTAGAATTGCTGCAGGCCCAGGTTA
AATATGAAATTACTCCCTAGGCTTTGCAGTTTATGTTACCAACCACCACATTTTATAGCTATGTAGAGGA
TGACTCTTAGGAAATAAATATTAGAAGCCTAGAAATCATTTAGTTGTTCTAGCACCAAATCTATCCATTT
GCCTAATGTATTTAACATTCCATCCTCATCAACATGATGAAGCCCCTTTCTTCCATCTTTGTAGGGCACA
TTGTATATAAATATTTTGTACATAAAGATCATCAAATACCATAATGGGGTATTTGGCTTCATCTGGAAAA
TTGACTGGAGGGAGATGCTGTCTCCCAGCCCTGCTTCCCTCGTCCCTGTCCAAGTTGCTGCAGGCCCAGG
TTAGAAGATTACCAACCTGGAGGGGCATGCAGTTCATCTTACAATAAAAGCCCATTCATTTAAAAACTCA
GAAATCATCCCAGTGCCTGTACTCCTCAAACCAATTTCCCTAAGGGAAGACTGGCACACCAGCCCAAAGA
GCAGGTGCTTCTCTTCCAACAGAAACATGGCCCCTGACAGGGCACCAGCATTAGGGAAACCAATGTCCTC
CGAATAGCTGCCATGAGAACATTTCAGATGCTCAAACTGAAAATTCTTAAAACCAATATTAAGCATCAGC
ATGCTTTAAGTGTAAGATAGCCCTTTGGAATTTACAAACACATGTGCAGCTATTTCCTTCTTCACAGATA
TGATGTACTCAGCCCCCTCCTAGGCACTACGAAGAAGACAGAGGAAGCATAAAAATTCTGGACTAATATA
ATTTTATATGTGTTTCTGAGATTGGGGAGTAGACTGAGTGCCTTTTTTACAAAGAAGATCCCATATTTAA
TTCAAGTATTTATAGCATCAGCAAAAATGGGCAGAGGGCGGAAGTTGAGAACACTAGGTTCTGTGCTAT
GTTACCTGTATTCAGTAGAAGTGTTTCTGGAGTCAGGTTTTAAGTCATGATCCTGAAGCTTCCTTCCCCT
CTTCCACTAATGATGCAATAATAGCTGTTTTCATTTTAACGAGCAGAGAACTAAGAGGAAAGGTCCTAGC
TCTGCCTTCCACTTGCAGCTTCCCTTTACCTCCTCTTATTGCTTTCATCTCAAATATCCCTGCTACTCAA
CCAATCCTAAAGCTAAAGTACTGAGATGCACACAAAGGAAAGGTGTGAGAGTGCTTGGAAGCATCCAGCT
GAGCCCACTGGATGAAAATCAGACGATAGGGCCTCCTGTTGTAATATACTAGCCAGAGAAAAGCGCCAAG
```

Figure 20 (Continued)

```
AACTTCAGGGATATTATTCACTGCTTTATTGCTCCCTAACCCTAGATCAGATTGGATTTTACTTTGTAGT
TCAGGAGTTAAGAAGTCAAATTGCTGACCGAGGTGGGGAAGGATGATGGAAATTAAAGGTTTACATTTGT
TTAATGGCAGAACTGAGATTTGCTCAGCTTATCTCTTTCCCATCTGTCTGTAATAGCAATGACTGAATAA
TCAGTAGACCAATGGAAGAGGAGTTGCAAGTTTAAATTTGTAACCTGACTCTGGGTTCTGTTCTAGGAAT
AGTGCATGTTTTAGAGGCTTTGCCAGTTGGGATACATTGTTGACTTGGGGGAGGATGAAGGAGAGAACTG
ATGACCTAGACATAGAAAAGAGTAGTTAACTAACTAGATGTTCTTCTGATCTCTTCCATGGTAGACATTC
TGAGCACATTGGCCCAGTTAGTTGGTATGGTGAAGGGGCACCGTACTAACAGATTTGGAGACTGAAACCT
AATCCCATCACCAACACTTAGCAGGTATATGATCATGGGCAATTCATTCAATTGCCTGCCAATTATAGAC
TATATAGGGGAAGAGCACTGGATTTGGAGTCAAGAAACCTGGACACTTGGCTCCACACTTCCTTAGCTG
GGTAACTTTGGGCAAACCGCTTGGTCTCTCAAGCCTAAGGTTCTTCAGCTATAAAATGGGAATAATACTT
CACTAACTACCTCACAGAGTTGTGGTAAGAATATAATCAGATAACTGGATAAAAACACTATATAAACTGG
AAAGCGCCGTACAAATGTGAGAGATCAGTTTTATTATCAAATCACTGTTTTCCACTGCCTCTTGAATCGG
CTTTATTCTAACCAACCATTACATCTTTCTCATCTTTTGGAGTATGGGTAATTGAGGCTTGGGTGTGTCA
TCAGGGACTGGAGTTATTTCAGCTCCCATGTAGAGGTGGGAGAGGTGGTTGATGGGCAGTGGAAGTTAG
ATACCAGCGATGTATATGGTAGGACATTTTCCTGGGTCACTTTGACAGTACCTTGGGAAATTGTCAGTCC
TTGCAGAGGGCCTAGGCTGGGCACAAGGGAGAAAGCGAACAGTTGACTAAGAATTGAGGGGAGGGTCTGG
AGCGCTACTGCCCTCCTGTCATTGCTGTGGGTGGGAGAGGCTAAGACTTCAGGTTTGACTGGAGGCCTAG
GAGAGAAGAGTGTCCTTAGGGTTTCAAGAATTTTAATGCCTAGCAGCTGAGTAACAGGCATTAGTTCTGA
TAGATAGTGAAGGGGAGAAAGTGCCACCTGTTGTGAGATCACCTCTCCAGGGCAGCAGCTGCCTTGTTAT
CACCAGCAACCTTAGCCCTGGTCAGTAATATTTCTGCTAAGAAAGGTTTTGAAGCATGGCCTCCAATGAC
TTTCATAAGCCCTTGGAGGCAGGACTGTGTCTCATCCATCTTTGTATCTTCAGTACCATCTTGTAAGGTG
CCTTGTACATAGTAGGTGCTTAATGAACAAATGTTGCTTGAATTTAGCTGTCGTCCAGCCCCACAGAGTT
ATGCTCCATTTGCCACCATGTGATATTTTTGAGAAACAATAGTGATTTGGATGCCAGCTCTATGTGACTT
TGGGCAAGACTCTCCATCTATCTTGTCTTCATTTCATCTGTAAAATGAAGTGAGTAGATTCAATGCTCCC
TAAGGTCCCTTCCAGCTCCAATACTTGACAAGCTTGTGATTCTAAATCGTTTCCGTTGCCTCTGAACATG
GGTGAGTAATGCCTCCACTGCAGCTGTTTCTCTCCAGGAGGCTTTGTTCAGAGGAGGTCTGACTATTGCA
CAGCCAGTTTTTTCTTCCTCTTCAGCAGTTCTTTACTGTCTTCAGAATGGTTCTGGATAAGCGGCCTTTT
CTGAAAGGATATTTAAAAATATATACTATTTAGGCTGGGCCCAGTGGCTCATGCCTGTAATCCCAGCACT
TTGGGAGGTGAAGGTGGGTGGATCACCTGAGGTCAGGAGTTCAAGACCAGCCTGGCCAACATGGTGAAAC
CCCGTCTCTACTAAAAATACAGAAATTAGCTGGGCCCTGTGGCAAGAGCCTGTTATCCCAGCTACTGGGG
AGGCTGAGGCAGGAAAATCGCTTGAACCCAGGAGGTGGAGGTTGTAGTGAGCCGAGATCACACCACTGCA
CTCCAGCCTGGGTGACAAGAACGAAACTCCATCTCAAAAAATAAAATAAAATATATACTATCTTGCTCCT
CAGAACCAGTGGGGAAGAAGAGGGAAGGCAAAGAAAGAAACTGAGCATAGTAAACACAGCATTTTTTGT
AGGCTCTTATTTAAAATGTGTGTGTGTGTGTATGTGTGTGTTTCTGAGTAAGTATTGACTGGGAAAAA
GAGAGAAGTCAATCAAAAGTATACTGTGCAATTGAGAGAGGCTGGCCCAAGATTTAAAACTTCCTGTGGG
TAATCTAACTGTGAGTAGATAGGAATCGGCCATATGACGAAATGAGATCAATAGGAAATGTGCTTTTTGA
GGAAATTTTATTTTAGTACCAAATGTTGCCAGTGACAATCTTCAGTTAAGAAGTAAGTTATTCTGACCTA
AAATTCTTATCTCTGCCACTTTGGTTTAAAAACAAAAACCCTTATATACATGGAATAGTTATATTTTAAT
TAAGCATTTATTTTAGTTGTTTTCATCCATTCAAGCAAAATGAATAAGCAGCATTTTTCATTGCACTTAA
AAATGTAAAATACCTGCATGCCACTAATCTGTAACATTTTACCAGTTCAGATGCCTGTAATGTGTGACTT
TATGTGTGTCTGTGTTGTTTTGAAGAGAATAAAGGAAATAATACTTTGCAAACTGTTTAAACAAGTGTTT
AAACTTCTATTGGCAACATTTATTGGGCTAAGCAGTTATTGAAAACTCCGCATAGTTTTATTTTCCATTT
```

Figure 20 (Continued)

GAAACTTCAATCAAATCAAGACTATTATATTCATTAGGGAATTAAAGACTAATTTGCTTTTTAAATGTGA
AGTTGAACACTGTGTGGAAAGTAAATGTGTGATGAAGCAAAATGTATAAAGTATGAAATATTATACTTTT
ACCCTGGATAATTATTCAGGACCCCAGTTGGCCCAAATAGGTGCAATTTTTAATCCTTTGAAATTAGCCA
GCCAGACCTAATGCTAAGGTAAATGTAAACTGTTTTAATTAATTAAGATCTTTCTGCTTTCGAAGGTATA
ATGTATCTATTTCTGTCAGGAATGATATTTCCAAATGAAAATGTAAAGAACATTGGGAAATAATAAACTT
TCCTTTCAAAGTAAAA

>gi|148368986|ref|NM_014551.4| Homo sapiens non-SMC condensin II complex, subunit
H2 (NCAPH2), transcript variant 1, mRNA
GCGCCTACGCATTTTCCTGGGCGGGAACAGCAAAATGGCGCCAGAACTAGTGGCGGGCTGAGGACGCCGT
ACCCCTCGGAAGGCAGCCCTGCGGTCCCTTTGCCGCCCGTTCCCTCCCGGACATGGAGGACGTGGAGGCG
CGCTTCGCCCACCTCTTGCAGCCCATCCGCGACCTCACCAAGAACTGGGAGGTGGACGTGGCGGCCCAGC
TGGGCGAGTATCTGGAGGAGCTGGATCAGATCTGCATTTCTTTTGACGAAGGCAAGACCACAATGAACTT
CATTGAGGCAGCGTTGTTGATCCAGGGCTCTGCCTGCGTCTACAGTAAGAAGGTGGAATACCTCTACTCA
CTCGTCTACCAGGCCCTTGATTTCATCTCTGGAAAGAGGCGGGCCAAGCAGCTCTCTTCGGTGCAGGAGG
ACAGGGCCAATGGGGTTGCCAGCTCCGGGGTCCCCCAGGAGGCAGAGAATGAGTTCCTGTCGCTGGATGA
CTTCCCTGACTCCCGGACTAACGTGGATCTCAAGAATGATCAGACGCCCAGTGAGGTCCTCATCATCCCC
CTCCTGCCCATGGCCCTGGTGGCCCCTGATGAAATGGAGAAGAACAACAATCCCCTGTACAGCCGTCAGG
GTGAGGTCCTGGCCAGCCGGAAGGATTTCAGGATGAACACGTGCGTTCCCCACCCCAGAGGGGCCTTCAT
GTTGGAGCCAGAGGGCATGTCCCCCATGGAACCAGCGGGCGTTTCCCCCATGCCAGGGACCCAGAAGGAC
ACCGGGAGGACTGAGGAGCAGCCAATGGAAGTTTCCGTGTGCAGGAGCCCTGTCCCAGCACTCGGCTTCT
CCCAGGAGCCAGGCCCCTCTCCAGAAGGCCCGATGCCCCTGGGTGGGGCGAGGACGAGGATGCAGAGGA
GGCAGTAGAGCTTCCTGAGGCCTCGGCCCCCAAGGCCGCTCTGGAGCCCAAGGAGTCCAGGAGCCCGCAG
CAGGTGGGACCCACATGGAGGCCTGCAGAACCTGAGCTGTGAACTGGCAACCCTGGCTCTGGGGCCGAGT
CACCTTGCACAAGGAGGACAGTGGTATGGCCTTGGCCCCAGACCACTGGTCTGGGGCAGAAGCCCACCTG
TCTTGCAGCCCGTCCTGCAACCAGCCCTTTTGAAGAGCAGCTTCTGTGTTCCTCCCCTCTCTGAGCAGAA
CTGATGCTCCTCAGAGTAGTGGGCTGCGTCCAAGGATTTGAGCCCTGTCGAGCTCACGGCAACCTGGGA
TGGCCGCCGGTTGCCAAGGCGCCTCTCTGCAGTCGGGCTGGTAGGAGGGAGTGTCTGGAGGCCATTGCTG
CCTCCCTCAACCCCCGGGGTCAACTGTACCCAGCCTAGAGCCAAGAAATCCTTCCTTTTTATTCATTAAA
ACAAAATCAACCTGATGCATACAGAAAAAAAAAAAAAAAA >gi|315467839|ref|NM_014891.6| Homo sapiens PDGFA associated protein 1 (PDAP1),
mRNA
GGTCCTTGCGGCCACTGCGGCCACTGAAGCGGCGGCGGCGGCTGGCCCAGGAGGAAGAAGTCGAGCCCAA
GCTATTTCCGGTTCCGGTGTCAGTTCGAGGCGCCGCCGCCGCCGCCGCAGCCGCCGGAGCCGCAATGCCT
AAAGGAGGAAGAAAGGGAGGCCACAAAGGCCGGGCGAGGCAGTATACAAGCCCTGAGGAGATCGACGCGC
AGCTGCAGGCTGAGAAGCAGAAGGCCAGGGAAGAAGAGGAGCAAAAAGAAGGTGGAGATGGGGCTGCAGG
TGACCCCAAAAAGGAGAAGAAATCTCTAGACTCAGATGAGAGTGAGGATGAAGAAGATGACTACCAGCAA
AAGCGCAAAGGCGTTGAAGGGCTCATCGACATCGAGAACCCCAACCGGGTGGCACAGACAACCAAAAAGG
TCACACAACTGGATCTGGACGGGCCAAAGGAGCTTTCGAGGAGAGAACGAGAAGAGATTGAGAAGCAGAA
GGCAAAAGAGCGTTACATGAAAATGCACTTGGCCGGGAAGACAGAGCAAGCCAAGGCTGACCTGGCCCGG
CTGGCCATCATCCGGAAACAGCGGGAGGAGGCTGCCCGGAAGAAGGAAGAGGAAAGGAAAGCAAAAGACG

Figure 20 (Continued)

```
ATGCCACATTGTCAGGAAAACGAATGCAGTCACTCTCCCTGAATAAGTAACTGCGACCCGTGGGAGGAGA
TGCCGGGGACCTGGCCGCGCTGCCAGGACCTCTGCTGTGTCTCGCCCACCCTGTGCCCTGGCGCCGCTG
CAACAGCCCCTCATGGCCAGGAGCCCCCCATGGCCTGGGGCCTCCTCTTCATCTTGGCACAGAAATTGTT
TGGGGGATGGGGGGGGGACTGGGGGAGGGGTAGCTGCTATCTTTGAGACAGAAAGATGCAGGACAGCAT
TTCATATGTAACCATTTGAATGTTTTTGCTGTTTTTAGAATTCAGAGCCCTTGCTGGGGGGTGCCTGGGA
GATGGGGTAAGAAGAGCTTTCATTTGTCTGGTAGATAGATAGCATGTAAGGGGGTGGTTGTCCCAGGAGG
CAGCTGCTGACAGGTTTGCTACACACAGCCCCGACTGTGTTGCCTGGGTGCTCATTCAGAGAGGGCTA
TCATCTGGGAGCCTGTGCCCCTGGGTCCTCGAGGGTCATGGCTTGTCCCTGGTCAGTCCTGTCTGACTGA
CCTCAGGGCCTCACCTCTCTGCCCTTCCCTGCCCGGTTCCTACTCACCTGGCTAGGGCCAGTGCCCATTT
TCAGCCCTACCCATTGATCATTTCAAGAAACCTCTGTTTACTGTGTGGCACCCAGGCAAAACATGCTCCA
CAAATTCAACTTGTATATTTGGCAGATTAAACTTGACATTATCGTAATCTTTGTTTTGGCAATCCATCCT
TTGGCTTCCGTGCTCGAGCCGTTTTTACCCAGCTGGGTACGGTGCCACGTTCAGGCACGTGCACCCGGCA
AGGTTCAGGGCACATACCTACCTGGGGCATGACATCTGTCAGGTGGCACCGAGCAGGATGCGGGGATGGA
CCCTAGATACCACAGCCTGCCCCCTCCCCTCCTTTAGCCAAGTCAGGATCTTAGGCCTCAGCAGGCAGGG
ACCCTTCCAGGCCACAGTAGGCTGAAGCAGCACCAGGATCCTGGCCTGGCCTGGCCTGTAGGTGTCCCCT
GGTGGTTATAATTCTGTAACTCTAGGGGAGAAGGGGAATAGCACTAGCATTGGATGTCGCCAAGGCCCAC
ATTTTCCTGAGAGAAGCCACAAAAGATGTGCAAATGCCCTTCAGCACAGGACCTGGTGACATGACATAAA
CTCCAAGACAGAACCTCAGTTTACAGCACACGAAAAAAATATCTTGCCAACATTGTAATGACAAAATAAA
TTCCCGTGAAGTTCCACAACCAGGCCGGGCATGGTGGCTCATGCCTGTAATCCCAGCACTTTGGGAGGTG
AGGTGGGTGGATCATCTGAGGTCAGGAGTTCAAGACCAGCCTGGCCAACATGGAGAAACTCCGTCTCTAC
TAAAAATACAAAAATTAACCAGGCTTGGTGGTGTATGCCTGTAATCCCAGCTACTTGGGAGGCTGAGGCA
GGAGAATCGCTTGATCCCAGGAAGGCAGAGGTGGCAGTGAGCTGAGAACGCACAACTGCACTCCAGCCTG
GGTGACGAGCAAAACTCCATCTCAAAACAAAAGTTCCACAACCAGCCTGGAGTGTGTAGCCCCTTTGTCC
AGGAATTTGACTAGTCAATCAGTGACACCTGGTACTGGCAGTTTTGGGAGTGGCAGCCCAGGATGGACAG
CAGTGGGAGGGAACCATTTGGCATAAGGCCGTTGGGCTTCAGGATCAATTTTGTTGGCAAGCAGTAAAA
ATAAGCTATCTACCTATGGCCGTGCAAACACCAATCTCTCCCTGGAGTCCCAGCTACTTGGGAGGCTGAG
GCAGAAGGATTGCTCCCACGAGTTCTAGTGCAGCCTGGAAAACTTAGCAAGACCCCAAGGAAATAACAAA
AAACCTCTCCTTCCACATAGGCAAGCATGTCCATAATTACTTTTTTTTTTTTTTTTTTTTACACAGTT
GCATTTTATTACCTCCACATTTTGAAGCAGTTCATGACCAGCATAGTGCTTTGGGGGCATTTTTTTTTTT
TTTCAATAAATGAAAGCATTTAAGAAAAAAAAAAAAAAAAAAAAAAA

>gi|63079684|ref|NM_014943.3| Homo sapiens zinc fingers and homeoboxes 2 (ZHX2),
mRNA
TTTTGGCGTAGATTCCCCACTGATCGAGGCATTTTTTTTCCCTTTTTTTTTCCTTTTTTTTTTTCTTTTA
AAAATTTTGGCCATCGTTCTCCGTACGGGGCTTTTTCTGTCTGTCTGTCTGGCTGGCAGGCTGGCTTTC
CCCCTCTTTCCCACGGAGCCCGAGCCGGGCGCCGGTGGGGAGTGGGGAGTGGGTGGGGGGAGCCAGCAG
AGTTCCATTTTGGAACGCCCGTGCCGCGTCTCCGCGTTCCCAGCCCGGGTCCCCGCGTTCACAGCCCCAG
CGCAGGTCTGGATGTACCGACTGCTTTTGGAATAAAAAGATTCCCAGGATGTGAGCAACACGGGACCGAT
ATGATGCTTCCTGGTGTGTTTAGTGGTTGGTGCCATTCCAATTTCTGTGCTGAAATCATTCTGAAAACT
CAAACAGTAGACTTCAGCACACAAGGAAAGCCAAAGCCATTTGAGGGGAATAAAGCCAAAAGCCTTTCA
CCTTATTCGTTCCAAGAATCTCACCGCCCCCTCCTTATCCCCCTCCAAAAATAAGCCATTGCACACAGAC
AGGCAGCATGGCTAGCAAACGAAAATCTACAACTCCATGCATGGTTCGGACATCACAAGTAGTAGAACAA
```

Figure 20 (Continued)

```
GATGTGCCCGAGGAAGTAGACAGGGCCAAAGAGAAAGGAATCGGCACACCACAGCCTGACGTGGCCAAGG
ACAGTTGGGCAGCAGAACTTGAAAACTCTTCCAAAGAAAACGAAGTGATAGAGGTGAAATCTATGGGGA
AAGCCAGTCCAAAAAACTCCAAGGTGGTTATGAGTGCAAATACTGCCCCTACTCCACGCAAAACCTGAAC
GAGTTCACGGAGCATGTCGACATGCAGCATCCCAACGTGATTCTCAACCCCCTCTACGTGTGTGCAGAAT
GTAACTTCACAACCAAAAAGTACGACTCCCTATCCGACCACAACTCCAAGTTCCATCCCGGGGAGGCCAA
CTTCAAGCTGAAGTTAATTAAACGCAATAATCAAACTGTCTTGGAACAGTCCATCGAAACCACCAACCAT
GTCGTGTCCATCACCACCAGTGGCCCTGGAACTGGTGACAGTGATTCTGGGATCTCGGTGAGTAAAACCC
CCATCATGAAGCCTGGAAAACCAAAAGCGGATGCCAAGAAGGTGCCCAAGAAGCCCGAGGAGATCACCCC
CGAGAACCACGTGGAAGGGACCGCCCGCCTGGTGACAGACACAGCTGAGATCCTCTCGAGACTCGGCGGG
GTGGAGCTCCTCCAAGACACATTAGGACACGTCATGCCTTCTGTACAGCTGCCACCAAATATCAACCTTG
TGCCCAAGGTCCCTGTCCCACTAAATACTACCAAATACAACTCTGCCCTGGATACAAATGCCACGATGAT
CAACTCTTTCAACAAGTTTCCTTACCCGACCCAGGCTGAGTTGTCCTGGCTGACAGCTGCCTCCAAACAC
CCAGAGGAGCACATCAGAATCTGGTTTGCCACCCAGCGCTTAAAGCATGGCATCAGCTGGTCCCCAGAAG
AGGTGGAGGAGGCCCGGAAGAAGATGTTCAACGGCACCATCCAGTCAGTACCCCCGACCATCACTGTGCT
GCCCGCCCAGTTGGCCCCCACAAAGGTGACGCAGCCCATCCTCCAGACGGCTCTACCGTGCCAGATCCTC
GGCCAGACTAGCCTGGTGCTGACTCAGGTGACCAGCGGGTCAACAACCGTCTCTTGCTCCCCATCACAC
TTGCCGTGGCAGGAGTCACCAACCATGGCCAGAAGAGACCCTTGGTGACTCCCCAAGCTGCCCCCGAACC
CAAGCGTCCACACATCGCTCAGGTGCCAGAGCCCCCACCCAAGGTGGCCAACCCCCCGCTCACACCAGCC
AGTGACCGCAAGAAGACAAAGGAGCAGATAGCACATCTCAAGGCCAGCTTTCTCCAGAGCCAGTTCCCTG
ACGATGCCGAGGTTTACCGGCTCATCGAGGTGACTGGCCTTGCCAGGAGCGAGATCAAGAAGTGGTTCAG
TGACCACCGATATCGGTGTCAAAGGGGCATCGTCCACATCACCAGCGAATCCCTTGCCAAAGACCAGTTG
GCCATCGCGGCCTCCCGACACGGTCGCACGTATCATGCGTACCCAGACTTTGCCCCCCAGAAGTTCAAAG
AGAAAACACAGGGTCAGGTTAAAATCTTGGAAGACAGCTTTTTGAAAAGTTCTTTTCCTACCCAAGCAGA
ACTGGATCGGCTAAGGGTGGAGACCAAGCTGAGCAGGAGAGAGATCGACTCCTGGTTCTCGGAGAGGCGG
AAGCTTCGAGACAGCATGGAACAAGCTGTCTTGGATTCCATGGGGTCTGGCAAAAAAGGCCAAGATGTGG
GAGCCCCCAATGGTGCTCTGTCTCGACTCGACCAGCTCTCCGGTGCCCAGTTAACAAGTTCTCTGCCCAG
CCCTTCGCCAGCAATTGCAAAAAGTCAAGAACAGGTTCATCTCCTGAGGAGCACGTTTGCAAGAACCCAG
TGGCCTACTCCCCAGGAGTACGACCAGTTAGCGGCCAAGACTGGCCTGGTCCGAACTGAGATTGTGCGTT
GGTTCAAGGAGAACAGATGCTTGCTGAAAACGGGAACCGTGAAGTGGATGGAGCAGTACCAGCACCAGCC
CATGGCAGATGATCACGGCTACGATGCCGTAGCAAGGAAAGCAACAAAACCCATGGCCGAGAGCCCAAAG
AACGGGGGTGATGTGGTTCCACAATATTACAAGGACCCCAAAAAGCTCTGCGAAGAGGACTTGGAGAAGT
TGGTGACCAGGGTAAAAGTAGGCAGCGAGCCAGCAAAAGACTGTTTGCCAGCAAAGCCCTCAGAGGCCAC
CTCAGACCGGTCAGAGGGCAGCAGCCGGGACGGCCAGGGTAGCGACGAGAACGAGGAGTCGAGCGTTGTG
GATTACGTGGAGGTGACGGTCGGGGAGGAGGATGCGATCTCAGATAGATCAGATAGCTGGAGTCAGGCTG
CGGCAGAAGGTGTGTCGGAACTGGCTGAATCAGACTCCGACTGCGTCCCTGCAGAGGCTGGCCAGGCCTA
GACAGGGAAGTCTGTTAGAACTGCTGTGCTGATCAACGGGACGCTCCGTCTTTGAAGAAAGAAGAGATGG
TCTCTCCCCAGCCATGGGCCACCCTTGCCAGTGACTCCAAGTGGAACTACTTAGCTCGCGTGTGCCTGGA
GGGTGCGGGAAGTCCAGCGACTCTCAGACGCACCTCCCAGAGGACCGGTGGGAATTGTTCATAGTGCCAA
AGTCCTACTACTGCGTTTTCAATGGGTCCTTGTACATAGTTTGCTCCTCTGCCCTAGCCCTCACCTCTTG
CTATACTGGAACCGATTTGTACAATGTGGAATTTTGTTACCTTTTTAATCAAGGGCAACTTCCTTTTCC
AGCACTACCATTGTAAGGTTTTTTTCAGGAGGGAGGGCTAACCACCTTGCTTTTCTCTTTTCTCTTTTTC
TTTTTTTATTTTTGTTTTATTAATTTGGGGAAAGGGGTGTTAGCATTAGTGCCATGATATCTACTGGAT
```

Figure 20 (Continued)

```
TTTAAGTAGGGAGACTTTATTTTTAAAGGTAGGTTGAAATTTGGGAGATTTCTCGGCAGGAAGGGCTGAA
ATCCAGGCCCCTGTCTCAACTTGGAGAGAGGTGACAGACGGCAGATCTTCCAAATCAAATTCCTTTCCAG
TTCTTCCCCTGGCTGCCTTTTTGGGGGTCCCTGCCTTAGCCCCACACAAGGCTTTCTGAACTGCCAAGAG
GGGATCTGGCTTCTCAACTGCTCGGCCTCTTGGGCCAGGCTGTGCCCAGCCAGCCCTGGGAGAACTGGGT
AGCAGGTGGCTGACTTCTTTAAGCACCTTTCTAAATACCAGCAGAAGAGGCTCCCGCCTCTGTTAGCATG
ATCAGTACTATTGTGACATTAAAACAACAACAATAAGATCTTCCTATCTGGAGGGTACAGAGGTGAATGG
CTTTGGTTTTCATTTCTCTTCTTCACTGCCTTTTCTCGGTGTGGTATTTGACAAGATTTTAGCTCAAAGC
CTCACCATGAATTGATTTTTTTTGTTTGTGTGTGTGTTTGTTTTGGGACAATTTTAGATACCTGAGTGCA
CTTTTTCAGTTAGTCCTAACTTTTAAAAGAAGGAAAACCAAGAGACATATCTGGTGTACGTGTTGCAGTA
TGAACTCTGGTTGCAATCCCTCCCCGTCCCACACTGCCCCCATTTGAGTACACCGCACAAGTCAAACGC
TAGGAAGTTTGAATAAAACCAATTTTTCTAACTTGTTGCTCATTTGTTGTAACTCAATAAAGCAAAGACT
AAACATTTTTATAACCTTTAAAAAAAAAAAAAAA

>gi|53692181|ref|NM_015002.2| Homo sapiens F-box protein 21 (FBXO21), transcript
variant 2, mRNA
CGCACGCGCGCGCGGCGGCCCCAGGTACGCGGACAAGATGGCGGCGGCAGCAGTCGACAGCGCGATGG
AGGTGGTGCCGGCGCTGGCGGAGGAGGCCGCGCCGGAGGTAGCGGGCCTCAGCTGCCTCGTCAACCTGCC
GGGTGAGGTGCTGGAGTACATCCTGTGCTGCGGCTCGCTGACGGCCGCCGACATCGGCCGTGTCTCCAGC
ACCTGCCGGCGGCTGCGCGAGCTGTGCCAGAGCAGCGGGAAGGTGTGGAAGGAGCAGTTCCGGGTGAGGT
GGCCTTCCCTTATGAAACACTACAGCCCCACCGACTACGTCAATTGGTTGGAAGAGTATAAAGTTCGGCA
AAAAGCTGGGTTAGAAGCGCGGAAGATTGTAGCCTCGTTCTCAAAGAGGTTCTTTTCAGAGCACGTTCCT
TGTAATGGCTTCAGTGACATTGAGAACCTTGAAGGACCAGAGATTTTTTTTGAGGATGAACTGGTGTGTA
TCCTAAATATGGAAGGAAGAAAAGCTTTGACCTGGAAATACTACGCAAAAAAAATTCTTTACTACCTGCG
GCAACAGAAGATCTTAAATAATCTTAAGGCCTTTCTTCAGCAGCCAGATGACTATGAGTCGTATCTTGAA
GGTGCTGTATATATTGACCAGTACTGCAATCCTCTCTCCGACATCAGCCTCAAAGACATCCAGGCCCAAA
TTGACAGCATCGTGGAGCTTGTTTGCAAAACCCTTCGGGGCATAAACAGTCGCCACCCCAGCTTGGCCTT
CAAGGCAGGTGAATCATCCATGATAATGGAAATAGAACTCCAGAGCCAGGTGCTGGATGCCATGAACTAT
GTCCTTTACGACCAACTGAAGTTCAAGGGGAATCGAATGGATTACTATAATGCCCTCAACTTATATATGC
ATCAGGTTTTGATTCGCAGAACAGGAATCCCAATCAGCATGTCTCTGCTCTATTTGACAATTGCTCGGCA
GTTGGGAGTCCCACTGGAGCCTGTCAACTTCCCAAGTCACTTCTTATTAAGGTGGTGCCAAGGCGCAGAA
GGGGCGACCCTGGACATCTTTGACTACATCTACATAGATGCTTTTGGGAAAGGCAAGCAGCTGACAGTGA
AAGAATGCGAGTACTTGATCGGCCAGCACGTGACTGCAGCACTGTATGGGGTGGTCAATGTCAAGAAGGT
GTTACAGAGAATGGTGGGAAACCTGTTAAGCCTGGGGAAGCGGGAAGGCATCGACCAGTCATACCAGCTC
CTGAGAGACTCGCTGGATCTCTATCTGGCAATGTACCCGGACCAGGTGCAGCTTCTCCTCCTCCAAGCCA
GGCTTTACTTCCACCTGGGAATCTGGCCAGAGAAGGTGCTTGACATCCTCCAGCACATCCAAACCCTAGA
CCCGGGGCAGCACGGGGCGGTGGGCTACCTGGTGCAGCACACTCTAGAGCACATTGAGCGCAAAAAGGAG
GAGGTGGGCGTAGAGGTGAAGCTGCGCTCCGATGAGAAGCACAGAGATGTCTGCTACTCCATCGGCTCA
TTATGAAGCATAAGAGGTATGGCTATAACTGTGTGATCTACGGCTGGGACCCCACCTGCATGATGGGACA
CGAGTGGATCCGGAACATGAACGTCCACAGCCTGCCGCACGGCCACCACCAGCCTTTCTATAACGTGCTG
GTGGAGGACGGCTCCTGTCGATACGCAGCCCAAGAAACTTGGAATATAACGTGGAGCCTCAAGAAATCT
CACACCCTGACGTGGGACGCTATTTCTCAGAGTTTACTGGCACTCACTACATCCCAAACGCAGAGCTGGA
GATCCGGTATCCAGAAGATCTGGAGTTTGTCTATGAAACGGTGCAGAATATTTACAGTGCAAAGAAAGAG
```

Figure 20 (Continued)

```
AACATAGATGAGTAAAGTCTAGAGAGGACATTGCACCTTTGCTGCTGCTGCTATCTTCCAAGAGAACGGG
ACTCCGGAAGAAGACGTCTCCACGGAGCCCTCGGGACCTGCTGCACCAGGAAAGCCACTCCACCAGTAGT
GCTGGTTGCCTCCTACTAAGTTTAAATACCGTGTGCTCTTCCCCAGCTGCAAAGACAATGTTGCTCTCCG
CCTACACTAGTGAATTAATCTGAAAGGCACTGTGTCAGTGGCATGGCTTGTATGCTTGTCCTGTGGTGAC
AGTTTGTGACATTCTGTCTTCATGAGGTCTCACAGTCGACGCTCCTGTAATCATTCTTTGTATTCACTCC
ATTCCCCTGTCTGTCTGCATTTGTCTCAGAACATTTCCTTGGCTGGACAGATGGGGTTATGCATTTGCAA
TAATTTCCTTCTGATTTCTCTGTGGAACGTGTTCGGTCCCGAGTGAGGACTGTGTGTCTTTTTACCCTGA
AGTTAGTTGCATATTCAGAGGTAAAGTTGTGTGCTATCTTGGCAGCATCTTAGAGATGGAGACATTAACA
AGCTAATGGTAATTAGAATCATTTGAATTTATTTTTTTCTAATATGTGAAACACAGATTTCAAGTGTTTT
ATCTTTTTTTTTTAAATTTAAATGGGAATATAACACAGTTTTCCCTTCCATATTCCTCTCTTGAGTTTAT
GCACATCTCTATAAATCATTAGTTTTCTATTTTATTACATAAAATTCTTTTAGAAAATGCAAATAGTGAA
CTTTGTGAATGGATTTTTCCATACTCATCTACAATTCCTCCATTTTAAATGACTACTTTTATTTTTTAAT
TTAAAAAATCTACTTCAGTATCATGAGTAGGTCTTACATCAGTGATGGGTTCTTTTTGTAGTGAGACATA
CAAATCTGATGTTAATGTTTGCTCTTAGAAGTCATACTCCATGGTCTTCAAAGACCAAAAAATGAGGTTT
TGCTTTTGTAATCAGGAAAAAAAAAAATTAATGAACCTTAAAAAAAAAAAAAAAGGTTTTGAAGGGAAAA
AAAGTGGTTTCACACCTCTTGTTATTCCTTAGAGTCACTTCAAGGCCTGTTTGAATGTGGCAGGTTAGAA
AGAGAGAGAATGTCTTTCATTTGAAGAGTGTTGGACTTGTGTGAAAGGAGATGTGCGTGTTGGAATCTGC
TTTTCCAAGCCGCCAGGGTCCTGACGGCAGCAGGACGAAGCCTGTTGTGGCGTCTTCTGGGAAAGCCTGA
CCGTGTGTTCGGACGGCACTGGCTCCTTTCCGAAGTTCTCAGTAACTGAGCCCAGAGTAACTGCACGCCT
TTGTGCAGCTCTGGAGCTCCACCAACTCTCGGCCTGCCAGTTCTCAAGCGAGCTAATCTTGTCATTAATC
GATAGAAGCTAACTTCCGAAGTTAGGACCTAGTTACTTTGCTCTCAACATTTAAAATAATGCAGTTGCTC
TAGTGAATGGGGCGTTAGGGGCCTGTCTCTGCACCTGTCTGTCCATCTGCATGCAGTATTCTCACCCATG
TTGAATGCCTGCTGCTTGTTTACCCTTTGGAAACCCTGGGGTGACCAAGGTTTGGAAAGCCACCTGAGAC
CACTTCATAGCAAGGGAAGGCTTTAAGCAGTTACTAGAAAGAGATGGGGATTTGGCCCCTGGCTCCTCCA
GCCTGAATGAGCTATTTAATCCACTGTCCATGTTCCTCATCAGTCAAATCCAAAGTCAAAGGATTTGAAC
CTGCATCTGGAAACGTAACCACTCACAGCACCTGGCCCGCCAAGGTTGGGAGGATTGTACACTACTTTCA
TTTAAAGGGGAAAGTTTGATAATACGGAATTAATTAATATGAATGAGATGCATTAATAAGAACCTGAGCA
TGCTGAGAGTTGCAATTGTTGGTTTTCTGGTTTGATTGATTTCCTTTTTTCTTAGACACATCAAAGTCAA
GAAAGATGGTTTTACCTTTACTGACCCAGCTGTACATATGTATCTAGACTGTTTTTAAATGTCTTTCTTC
ATGAATGCTTCATGGGGCTCCAGGAAGCCTGTATCACCTGTGTAAGTTGGTATTGGGCACTTTATATTT
TTCTAAAAACGTGTTTGGATCCTGTACTCTAATAAATCATAAGTTTCTTTTTAAAAATTTTCCAAAACT
TTTCTCCATTTTAAAAAGCCCTGTTATAAACGTTGAACTTTCACAATGTTAAAATGTTAAATATTTGGAT
ATAGCAACTTCTTTTCTCTTCAAATGAATGCCAAGATTTTTTTGTACAATGATTAATAAATGGAACTTAT
CCAGAGAAACCAAAAAAAAAAAAAAAA

>gi|221139708|ref|NM_015184.5| Homo sapiens phospholipase C-like 2 (PLCL2),
transcript variant 2, mRNA
GAAACGTACCTAAGTATTATTGGACAGCCGGAGTATTTTACAGTGGTTGCTGCTCAGGAAATTTGAGTGA
AGGACTGCAAAAGAGGAGCAAAGCAGACCCGAGAGAGAAGGCAGCAGTGCTCCCCTGTGACGTGCTCCAT
CACCGGGCAGGGAAGACACCGCTGCCACCTCTCCACAGCCTTGTTCAAGAGCACTGGAAATTGATGGTAC
AAAACAGAAGAGGGAACGGAAAAAGACAGTCTCATTCAGCAGCATGCCAACAGAGAAGAAGATCAGCAGT
GCAAGTGATTGTATTAATTCAATGGTTGAGGGTTCAGAACTCAAAAAGGTTCGCTCCAACTCTAGAATTT
```

Figure 20 (Continued)

```
ATCATAGGTACTTTTTACTGGATGCTGACATGCAGAGCCTAAGGTGGGAGCCATCTAAGAAGGATTCTGA
GAAAGCCAAGATTGACATTAAATCCATCAAGGAAGTGAGAACAGGAAAAAACACAGACATATTCCGCAGC
AATGGCATTTCTGACCAGATATCTGAAGATTGTGCGTTTTCCGTCATATATGGAGAGAATTATGAGTCAC
TGGATTTGGTTGCCAACTCCGCAGATGTTGCAAACATCTGGGTTACAGGACTGCGGTACCTAATTTCTTA
TGGAAAACATACACTTGATATGTTAGAAAGTAGCCAAGATAACATGAGGACTTCTTGGGTTTCACAAATG
TTTAGTGAAATTGATGTAGATAACCTTGGACATATAACTCTGTGTAATGCTGTGCAATGTATCAGAAACC
TCAATCCTGGTTTAAAAACGAGCAAAATTGAGCTTAAGTTCAAAGAATTGCATAAATCAAAGGACAAAGC
TGGTACCGAGGTCACAAAGGAAGAATTTATTGAGGTTTTTCATGAGCTTTGTACTAGACCTGAAATTTAT
TTCCTTTTAGTTCAGTTTTCAAGCAATAAAGAATTCCTTGATACCAAGGACCTTATGATGTTTCTTGAGG
CAGAACAGGGTGTGGCACATATAAATGAGGAAATAAGCCTTGAAATTATTCACAAATATGAACCATCCAA
AGAGGGTCAGGAAAAGGGCTGGCTCTCCATAGACGGGTTCACTAATTACCTTATGTCACCTGACTGTTAT
ATATTCGATCCAGAACATAAGAAGGTCTGTCAGGATATGAAGCAACCTCTGTCTCATTACTTTATAAACT
CATCTCATAATACATACTTAATAGAGGATCAGTTCCGAGGTCCCTCCGACATCACAGGATATATTCGAGC
TCTTAAAATGGGTTGCCGGAGTGTTGAATTAGATGTATGGGATGGGCCGGACAATGAACCTGTAATTTAC
ACAGGCCACACCATGACCTCTCAGATAGTTTTCCGCAGTGTCATTGATATTATTAACAAGTATGCATTCT
TTGCTTCAGAGTATCCTCTTATCTTGTGTTTAGAAAACCACTGTTCCATTAAACAACAGAAGGTAATGGT
TCAGCACATGAAGAAACTTTTAGGAGACAAGCTCTATACAACATCACCCAATGTTGAGGAATCTTATCTA
CCATCCCCAGATGTCCTGAAAGGGAAAATACTAATTAAAGCAAAGAAGCTGTCCTCAAATTGCTCTGGGG
TAGAAGGAGATGTTACTGACGAAGATGAAGGAGCAGAAATGTCTCAGAGGATGGGAAAAGAGAACATGGA
GCAACCCAATAATGTGCCTGTGAAGCGATTTCAGCTTTGTAAAGAACTGTCTGAACTGGTCAGCATCTGC
AAATCAGTTCAGTTCAAAGAATTTCAGGTGTCGTTTCAGGTTCAGAAGTACTGGGAAGTCTGTTCCTTTA
ATGAAGTGCTTGCCAGCAAGTACGCCAATGAAAATCCAGGGGACTTTGTAAATTACAACAAACGTTTTCT
TGCTAGGGTTTTTCCCAGTCCAATGAGAATTGATTCCAGTAACATGAATCCTCAAGATTTTTGGAAATGT
GGTTGCCAAATTGTAGCCATGAACTTTCAGACACCAGGACTGATGATGGACCTGAATATTGGCTGGTTTA
GGCAGAACGGAAACTGTGGCTATGTCCTCCGGCCAGCCATCATGAGGGAGGAGGTCTCCTTCTTCAGCGC
CAATACAAAAGACTCTGTCCCAGGGGTCTCACCTCAACTTCTTCACATTAAAATCATCAGTGGGCAGAAC
TTTCCCAAGCCCAAAGGATCAGGTGCCAAAGGTGATGTGGTAGATCCTTATGTCTATGTTGAAATCCATG
GAATCCCTGCTGATTGTGCAGAACAAAGGACAAAAACAGTGCACCAGAATGGAGACGCTCCCATTTTTGA
TGAAAGCTTTGAATTTCAAATCAACCTGCCTGAACTGGCCATGGTGCGCTTTGTAGTGCTGGATGATGAC
TACATTGGGGATGAATTCATCGGCCAGTACACAATTCCCTTTGAATGTTTACAGACGGGCTACCGCCATG
TCCCCCTGCAGTCCTTAACTGGAGAGGTCCTTGCACATGCTTCTTTATTTGTCCACGTGGCTATTACTAA
CCGAAGAGGAGGAGGAAAGCCTCATAAAAGGGGCCTTTCTGTGAGAAAAGGGAAGAAATCCAGGGAATAT
GCATCTTTGAGAACACTGTGGATTAAAACCGTGGATGAGGTATTCAAGAATGCCCAGCCCCTATACGGG
ATGCCACAGATCTGAGAGAAAACATGCAGAATGCGGTGGTGTCATTCAAGGAGCTGTGTGGCCTCTCCTC
TGTGGCCAATCTCATGCAGTGCATGTTGGCGGTGTCTCCCCGCTTTCTGGGCCCGATAACACACCCCTA
GTGGTCCTAAATCTCAGCGAGCAGTACCCCACAATGGAGCTGCAGGGAATTGTGCCGGAGGTTCTGAAGA
AGATCGTAACAACTTATGACATGATGATTCAGTCCCTCAAGGCGTTGATTGAAAATGCAGATGCTGTATA
TGAAAAGATCGTACATTGTCAGAAGGCAGCCATGGAATTCCATGAACACTTGCACAGCATAGGCACCAAG
GAAGGTTTGAAGGAAAGAAAACTACAAAAAGCAGTGGAGAGCTTTACCTGGAATATTACCATCTTAAAGG
GACAAGCAGATCTTTTGAAATATGCTAAGAATGAGACATTGGAGAACCTGAAACAAATCCATTTTGCTGC
TGTTTCATGTGGACTGAATAAACCAGGCACCGAAAATGCTGATGTCCAGAAGCCACGCCGGAGCTTGGAA
GTCATACCCGAAAAAGCAAACGATGAAACTGGAGAATGAGGAAACTTACAATAAACCATTATGGAGTTTA
```

Figure 20 (Continued)

TAACTCTAGGACCAATTGTAGTCAGATGGGACATTTGCTTTGCACTCACTAATGAGAATAATATTCGGGA
TTTTAAAGCACAACTGGAATAGCTAATTACAGTCTATTAAAACTGTAATGTATGTAGCAATCCTGCGTG
TGAAGGCAAATAAACTCTTTAACAGGCAATTATATTGCTGGCCAAAATATGCTATATTTGTATACAAAGA
CATTCTAACTCAGTTCCAGTATGAAGAAAGATTATTCACTCTAGCTCCACTGAGAAACATTTTCCTAAGT
GAAAACAATTTCTTAAGATGGAAATGGATTGGATTGTCAAATTATTATTTATTGGAGAAAAAAACCTGAT
CTACACATTTTTACTTATATGGGGTTGCCAGAGTCTCTGGGTTCTAGATGATTTTGGTGGCATGCTTGCT
GAGCCATAATTACTAAAGAGAATGTAAGTGGACGGGTTCCCTGAATCCCCGGGGTCCTTGGAGAGCCATC
GAGGAGAATGTGCAATTGGACTGAAGCTCCCTGGCTGAAGATACATGCCGAGTCAGCACATGGGTAGAGA
TGATGTAAAAGCAGCCAATCTGGAAACAATACATTGTAAATAGTTTTTCATTGTATGAAGTAGTGTTCAC
ATTAAAAAGATGTTTTATGATATTTCTCCAATAAAAAAAAAAAA

>gi|45827805|ref|NM_015459.3| Homo sapiens atlastin GTPase 3 (ATL3), mRNA
CACGCGGCAGGCGGTGGCGGGATTCTGCCGCGTGCGCTTTCCCGCCCCGCCTCGCCTAGCCTCGTCCTGC
GCTCGCCACGCCTCGGGCTGTCCGTTGGGCCACGCAGACCGCGCTGCGCTCGCTCCGTCGCGGCTCCGCG
TGCCCCACCTTCTGGCTAGTTTTTTCTAGAGCCCAGGCTCCGCCCGTTTCCCGCTTCCAGGGCCCGGTTC
GTTCCCGCCCGCACCCGTCCCTCTCCTCTGCACCCCTGCTGCTTCTGCTTTGAAGGCGGAGGCTCCATGT
TGTCCCCTCAGCGAGTGGCAGCAGCTGCCTCAAGAGGAGCAGATGATGCCATGGAGAGCAGCAAGCCTGG
TCCAGTGCAGGTTGTTTTGGTTCAGAAAGATCAACATTCCTTTGAGCTAGATGAGAAAGCCTTGGCCAGC
ATCCTCTTGCAGGACCACATCCGAGATCTTGATGTGGTGGTGGTTTCAGTGGCTGGTGCCTTCCGAAAGG
GCAAGTCCTTCATTCTGGATTTTATGCTACGATACTTATATTCTCAGAAGGAAAGTGGCCATTCAAATTG
GTTGGGTGACCCAGAAGAACCGTTAACAGGATTTTCCTGGAGAGGGGGATCTGATCCAGAAACCACTGGG
ATTCAAATCTGGAGTGAAGTTTTCACTGTGGAGAAGCCAGGTGGGAAGAAGGTTGCAGTTGTTCTGATGG
ATACCCAGGGGGCATTTGACAGCCAGTCAACTGTGAAAGACTGTGCTACCATCTTTGCTCTAAGCACTAT
GACTAGTTCTGTTCAGATTTATAATTTATCTCAGAACATTCAAGAAGATGATCTTCAACAGCTGCAGCTC
TTCACAGAATACGGTCGTCTGGCAATGGATGAAATTTTCCAAAAGCCTTTCCAGACACTGATGTTTTTGG
TTAGAGATTGGAGTTTCCCTTATGAATATAGCTATGGACTCCAAGGAGGAATGGCATTTTTGGATAAGCG
TTTACAGGTGAAGGAACATCAACATGAAGAAATTCAGAATGTTCGAAATCACATTCACTCATGTTTCTCC
GATGTCACCTGCTTTCTCTTACCACATCCAGGACTCCAGGTGGCCACAAGCCCTGACTTTGATGGGAAAT
TAAAAGATATTGCTGGTGAATTCAAAGAGCAGTTACAGGCACTGATACCGTATGTATTAAACCCATCTAA
GTTAATGGAAAAGGAGATCAATGGCTCAAAGGTCACCTGTCGGGGACTACTGGAGTATTTTAAGGCATAT
ATTAAAATTTATCAAGGAGAAGATCTGCCTCACCCCAAGTCCATGCTTCAGGCCACTGCTGAAGCCAACA
ACTTAGCAGCTGCAGCCTCTGCCAAGGACATTTATTATAACAACATGGAAGAGGTTTGTGGGGGAGAGAA
ACCTTATTTGTCTCCAGACATTCTAGAGGAGAAGCACTGTGAATTCAAACAACTTGCTCTGGACCATTTT
AAGAAGACCAAGAAGATGGGTGGGAAGGATTTCAGCTTTCGTTACCAGCAGGAGCTGGAGGAGGAAATCA
AGGAATTATATGAGAACTTCTGCAAGCACAATGGTAGCAAGAACGTCTTCAGCACCTTCCGAACCCCTGC
AGTGCTGTTCACGGGCATTGTAGCTTTGTACATAGCCTCAGGCCTCACTGGCTTCATAGGTCTTGAGGTT
GTAGCCCAGTTGTTCAACTGTATGGTTGGACTACTGTTAATAGCACTCCTCACCTGGGGCTACATCAGGT
ATTCTGGTCAATATCGTGAGCTGGGCGGAGCTATTGATTTTGGTGCCGCATATGTGTTGGAGCAGGCTTC
TTCTCATATCGGTAATTCCACTCAGGCCACTGTGAGGGATGCAGTTGTTGGAAGACCATCCATGGATAAA
AAAGCTCAATAGCATCTTAACGTGAAGATCAAACAAGAACACAACAAGCCCCTACTGATTTCTGGGTTTC
TGCCACGGCCACAGGTTCATATCCAGAGGAATGGCAGATCTGAGACGATCCAGGAAGAGCTAAAACATGG
CCCTGTAATAAATGAGCAGACCTCTCCTGTGGTTTCAAATTATTAAACACACTTCCATTTCTCTTGGAAG

Figure 20 (Continued)

CATTTCTTTTCCTTGCTGTTATAGATGCAAGCCTGTGTCTATTTTCATATTACTCTGCTTTGTGCACTTT
ATGGAGGAGGAAGCTAGAGGAAAAATGGAAATGCAGCTTTTAAGTTCTTTATGTGCCACTTAGTGCCTTT
TAAGATTGATTCCATG

>gi|354459347|ref|NM_015646.5| Homo sapiens RAP1B, member of RAS oncogene family
(RAP1B), transcript variant 1, mRNA
ACCCGCGCGCCCCGCCCGCGGGCGGAAGCTGGAGCGAGGCTGAACGCCTGACGTCAAGGCGACATCGCCA
AACCTCGCCCAGATTCAGGCGTGTAAACCAGCCGGAGCGGCGCGGCAGCGGCAGGACCGCCGTGGCGCCT
AGAGTAGCGACCCGGGGGGAGCGCGGGGCGACGCTGGCTGCAGGGACCCGGTGACAGCGTGAGAGGTTCG
CAGAGTACTAGGTTTTGACAAGCTTGCATCATGCGTGAGTATAAGCTAGTCGTTCTTGGCTCAGGAGGCG
TTGGAAAGTCTGCTTTGACTGTACAATTTGTTCAAGGAATTTTTGTAGAAAAATACGATCCTACGATAGA
AGATTCTTATAGAAAGCAAGTTGAAGTAGATGCACAACAGTGTATGCTTGAAATCTTGGATACTGCAGGA
ACGGAGCAATTTACAGCAATGAGGGATTTATACATGAAAAATGGACAAGGATTTGCATTAGTTTATTCCA
TCACAGCACAGTCCACATTTAACGATTTACAAGACCTGAGAGAACAGATTCTTCGAGTTAAAGACACTGA
TGATGTTCCAATGATTCTTGTTGGTAATAAGTGTGACTTGGAAGATGAAAGAGTTGTAGGGAAGGAACAA
GGTCAAAATCTAGCAAGACAATGGAACAACTGTGCATTCTTAGAATCTTCTGCAAAATCAAAAATAAATG
TTAATGAGATCTTTTATGACCTAGTGCGGCAAATTAACAGAAAAACTCCAGTGCCTGGGAAGGCTCGCAA
AAAGTCATCATGTCAGCTGCTTTAATATACTAAATGCATTGTAGCTCTGAGCCAGGTCTGAAGAACTGTT
GCCCAATTCAACAGTGCCAGCATTCCAACTTTGTTAAACCTACCAACATCTTAAATGGACTTTCCTGTGG
TGGTACCCTTTAAGAGGCGGATGAAAGCTACTATATCAGTTTGCACATTCTAATCACTTTCCAGTATCAC
AAGAGAGATTTTTACTTATATAATAGTCCTAGAGTTTGCAGCTGGTAAAACCAGAGGCTACATCCAGTAT
TACTGCTAAGAGACATTCTTCATCCACCAATGTTGTACATGTATGAAAATGGTGTACTGTATACTTTAAC
ATGCCCCATACTTTGTATTGGAGAGTACAATAATGTAAATCCTAAAAGCACCACTATTTTAGCATAATAA
AAGAAAGTCCAAAGAGCTCCTATATAGACTACTCCAGATAACTTCGCTTCTTTGATACTTGTAGCTTATT
GTAATTTTTTTAAGAAATTCAAGGTCATTATTATTGTACAAAATAAGCGCTTTGATTAACACAGCTATA
TAGTTTTTTTAATTTTTAAAAAACCTGTGGAGACGGTGATCTTGTCTTTAAAACATGATAGTCCTTTCAG
TATAATGTCTTAGATTAAAGACGTTGCCTTTAATATCTGTTGGGAAGGAAATGTCCAGACTTTTCAAATC
TCTTATTATATGTTTCCTTTTTTTGTTTACATAGGGAACAATGTTTATAGTCGTGTGTACAGTGGGGGTC
TACAACAAGAAGTGTATATTTTCAAACAATTTTTTAATGATTTAACAATTTTTGTAAATCATTTTCAGGC
TTCTGCAGCTGTAGATTCTCACTGTGAATCCCTTGCTGCTCATGCATAAGTGTATTTGCAATACCAAAT
ATACAGGTTTAGTATTTTTGCCTGTTAGTGATTGTTTCACATGTGTAACGTTTTGGTTGAGATGTTAAAT
GGTGGACGAGTACTGTGGATGTGAATGTGGGAAGTAATTTTAATCATATGTAATTGGTCACAAGGCCTAA
TTTGCAGTAACTATTGCTGTTTTATTTAACAATGCCTTGTTGCTTTGTATGCATTAATGTTTGGATGTAA
AGATTGTGTGTCTATCCAACAGGGAGCCACAGTATTTAAATTGACCAACCTAATGTTACAACTACTTTGA
GGTGGCCAAATGTAAACTAAAAGCCTTAATTAAAGTGGTGCAATTTTGTATAACTTAGCATCAGTAGTTC
AATAAATTTGGATTGCCATGCAAGGGCTTGCATTATAATTACTTGCCACTTGAATGTGTTTTGTGTAATG
TTTTAACAGTGCTAGTAAATAAATACGGGTTTACCCTGGTTTTAATTGTAAAAAAAAAAAAAAAAAAAA
AA >gi|88853582|ref|NM_015973.3| Homo sapiens galanin propeptide (GAL), mRNA
ATATAGCAGCGGCGGCGGTGGCGGCGGCCACACCGGGCGGCGGACACGTGGAGGGACCCGGCCCGCGCCT
TCTGCCCCTGCTGCCGGCCGCGCCATGCGGTGAGCGCCCCAGGCCGCCAGAGCCCACCCGACCCGGCCCG

Figure 20 (Continued)

```
ACGCCCGGACCTGCCGCCCAGACCCGCCACCGCACCCGGACCCCGACGCTCCGAACCCGGGCGCAGCCGC
AGCTCAAGATGGCCCGAGGCAGCGCCCTCCTGCTCGCCTCCCTCCTCCTCGCCGCGGCCCTTTCTGCCTC
TGCGGGGCTCTGGTCGCCGGCCAAGGAAAAACGAGGCTGGACCCTGAACAGCGCGGGCTACCTGCTGGGC
CCACATGCCGTTGGCAACCACAGGTCATTCAGCGACAAGAATGGCCTCACCAGCAAGCGGGAGCTGCGGC
CCGAAGATGACATGAAACCAGGAAGCTTTGACAGGTCCATACCTGAAAACAATATCATGCGCACAATCAT
TGAGTTTCTGTCTTTCTTGCATCTCAAAGAGGCCGGTGCCCTCGACCGCCTCCTGGATCTCCCCGCCGCA
GCCTCCTCAGAAGACATCGAGCGGTCCTGAGAGCCTCCTGGGCATGTTTGTCTGTGTGCTGTAACCTGAA
GTCAAACCTTAAGATAATGGATAATCTTCGGCCAATTTATGCAGAGTCAGCCATTCCTGTTCTCTTTGCC
TTGATGTTGTGTTGTTATCATTTAAGATTTTTTTTTTTGGTAATTATTTTGAGTGGCAAAATAAAGAAT
AGCAATTA

>gi|319918867|ref|NM_016069.9| Homo sapiens presequence translocase-associated
motor 16 homolog (S. cerevisiae) (PAM16), nuclear gene encoding mitochondrial
protein, mRNA
GGCAATGCGCATGCCCAGCGCCGTATCGCGCACGCGCTCTCTGCGGCTTTCCTTGACCTCTGACCCGCCG
ACCACGCTTGATCCCCGGCCGCGGGGCCAGGAAGTCGGAGTTTGAGCCCCGGAGGCAGAGCGGCTGCCAT
GGCCAAGTACCTGGCCCAGATCATTGTGATGGGCGTGCAGGTGGTGGGCAGGGCCTTTGCACGGGCCTTG
CGGCAGGAGTTTGCAGCCAGCCGGGCCGCAGCTGATGCCCGAGGACGCGCTGGACACCGGTCTGCAGCCG
CTTCCAACCTCTCCGGCCTCAGCCTCCAGGAGGCACAGCAGATTCTCAACGTGTCCAAGCTGAGCCCTGA
GGAGGTCCAGAAGAACTATGAACACTTATTTAAGGTGAATGATAAATCCGTGGGTGGCTCCTTCTACCTG
CAGTCAAAGGTGGTCCGCGCAAAGGAGCGCCTGGATGAGGAACTCAAAATCCAGGCCCAGGAGGACAGAG
AAAAAGGGCAGATGCCCCATACGTGACTGCTCGGCTCCCCCGCCCACCCCGCCGCCTCTAATTTATAGC
TTGGTAATAAATTTCTTTTCTGCAAAAAAAAAAAAAAAA >gi|290563142|ref|NM_016103.3| Homo sapiens SAR1 homolog B (S. cerevisiae)
(SAR1B), transcript variant 2, mRNA
GCCGGCCCGGAAGGGGCTGATGCGAACTGGGGCCACGGCAGCCATCGCGCTTTGCAGTTCGGTCTCCTGG
TGTACGGCCAACGCCAAGTAGGGGATTGCGTTCCCTCCAGTCGCAGACCCTATCAGATTTGGATATGTCC
TTCATATTTGATTGGATTTACAGTGGTTTCAGCAGTGTGCTACAGTTTTTAGGATTATATAAGAAAACTG
GTAAACTGGTATTTCTTGGATTGGATAATGCAGGAAAAACAACATTGCTACACATGCTAAAAGATGACAG
ACTTGGACAACATGTCCCAACATTACATCCCACTTCCGAAGAACTGACCATTGCTGGCATGACGTTTACA
ACTTTTGATCTGGGTGGACATGTTCAAGCTCGAAGAGTGTGGAAAAACTACCTTCCTGCTATCAATGGCA
TTGTATTTCTGGTGGATTGTGCAGACCACGAAAGGCTGTTAGAGTCAAAAGAAGAACTTGATTCACTAAT
GACAGATGAAACCATTGCTAATGTGCCTATACTGATTCTTGGGAATAAGATCGACAGACCTGAAGCCATC
AGTGAAGAGAGGTTGCGAGAGATGTTTGGTTTATATGGTCAGACAACAGGAAAGGGGAGTATATCTCTGA
AAGAACTGAATGCCCGACCCTTAGAAGTTTTCATGTGTAGTGTGCTCAAAAGACAAGGTTACGGAGAAGG
CTTCCGCTGGATGGCACAGTACATTGATTAACACAAACTCACATTGGTTCCAGGTCTCAACGTTCAGGCT
TACTCAGAGATTTGATTGCTCAACATGCATAACTTGAATTCAATAGACTTTTGCTGGTTATAAAACAGAT
GTTTTTTAGATTATTAATATTAAATCAACTTAATTTGAATGAGAATTGAAAACTGATTCAAGTAAGTTTG
AGTATCACAATGTTAGCTTTCTAATTCCATAAAAGTACTTGGTTTTTACAGTTTATAATCTGACATCACC
CCAGCGCCATTTGTAAAGAGCAACTTTCCAGCAGTACATTTGAAGCACTTTTTAACAACATGAAACTATA
AACCATATTTAAAAGCTCATCATGTTAAATTTTTATGTACTTTTCTGGAACTAGTTTTTAAATTTTAGA
```

Figure 20 (Continued)

```
TTATATGTCCACCTATCTTAAGTGTACAGTTAATAATTAGCTTATTCAATGATTGCATGATGCCTTACAG
TTTTCAATAACTTTTTTTCTTATGCAAACGTCATGCAATAAAACAAACTCTAATGTTTGGCATCCTTGTT
GGGCAAATGTTTCATTTAAATGTGTCTTATCTAGCTAGTATACTCTGAAAATTTGAGTATTTAATATTAG
GCATATGAAGTGGTTGTTGGGAAAGGAGATTCCTTCAGAATATTTAGAATAGCGTTTAAGGCTCTCAAGG
CTTAGGTATTTACCATGAGATGGTTGTGGTCAGTTGCACCTGATACCATGTATCCCTGAATCATGTGTAT
TTTTATTAGTAATGCAGCCACTACCATTGCTGATGGGGTCTGTGTCCTAGTCCCTGTGGGATTGGCCTTC
TGAAGAAAAGCACATTTATGGTACACAAGGTTGATTCTCAGTTTGGTAGGCTCTATAGTTCCATCCCAGC
TGTCTAATTCTGAAGTGCTCCAGTCTTATTGGTGCCCAATGGGGTAATCTGTGCCTCTTCCCCAAAAGCA
ATGACAGGCACCAGTGTCTCCACATTTAGATATATTCCCAGTCTCTGTACATTTAACAGTACTCTCTGGG
GCAAGCAATAAGTAGGACCTTGTGTGCAGTTTCATTGTAGAGACATGTATATCTGAGGAATAAAACAGCT
TGTTCTGTGTCAGTCTGAGATATGTGGAGATTTTGTTCCTATCCTATAGCTCTTTTGTATTCTTTGGCAT
ATTTTATATCCTGGTAGAAGAAAACAAGTGCTTGTTTCCAATTTTCTTTTTTCTTATTTGCTCTCAGGTA
GTTCTTACTCCATACAACAAAGACTTTTTGTTTGTTGGGCTTTTTTTTTTTTTTTTTTGCTCTGTTT
CATTTGTTTTAGAGACGGGGTTTCACCATGTTGTCCAGGCTGGTCTCAAACTCCTGACCTCAAGTGATC
TGCCCGCCTTGGCCTCCCAAAGTTCTGGGATTATAGGCGTGAGCTACCATGCCTGACCTGACTTTTGTTT
TTAGATATTATGCTTGCCATGTGATAGGGCCTGCAAGCCTCATTGCTAGGCTTACTAAGAAAATTTTAGT
TTTTCAAAAGCATTATAATTTCCTAAGAAACTGAATTCTTTTTTTATATGTTTGAGATTCCCATCATTAG
TAATATAAGATGAAAGGTAAGTGCCAAAAATGTATTTTTAAAGACCCTCAAGTTTAAGATTTATCCTGAT
TATAAGCCAAGTTTTATAGTATATTTAACCAATTCCATCAAGAATAATTTTAATATCAAAAATTAGTGTT
TTCTGTAGCCATTGTCCATGTCAGAGTTACAGTCCTTTTTGTCATTGATAATATAACCTATGAAGCAGAT
AAGGATTGAGGAATATGACTGGAAGGAATTACTATTTAGCTAAGCTGACAAGGTCGCTTCTTAAGATGAC
ATTTGGTTTCAGTAATCTGACTATTCTGTTTTCACTTTCATCTTCTTTCTAAATGAAAACAAAAGTGCTC
CCTCCCTTCCTGGAAACCTCAGTAACACTATGGGAAAAGTAGAACATGACATTGCAGCCTATTGATTTCT
TCTTCCAGATAGGTTTAAAGTACTCCTTAAGTTCTGACTAAATAGAACTAAGCCTTATTAAAAATAACTG
CCTCTTGTTCATGTTATCTGTACCTTCAGGGACCTGCCTTTCTTCAAGTATTTCCTAGAGTATCTATTAT
GATACTGAAGAAGCTAATTATTTGTGTTGTAAATGGGTATAAATGAAAAAAAAACATACTGGTTTCTCTA
GCCAGGAAAAATGCTTTCTGGTGTAATATATCTTGCTCCAGAACCCTCATTCTAATTGTAACACTAGGAT
CAAAGAAACAAAGTCACTTTGTGGACCACAGCTAAACTGTGGATATTTTCCCAAAGACATAAGATTTTTA
TGGCCCGAGCCTCTAGAAAGGAAGCCATGTTAGGAGCAACCAGCTTTCCTCCCAGCTTTAGGGGGCAGA
GTTCCTGAGCCAGAGGACTTACTGTCCAGCTTTGAGAACCTCTCCAGAGTATATGCACTGGGTACTGCTC
TTTTTCAAGAGAACCAAATTAAGAGGATGGCAAGAAACAGTAGAAGCACAGAGGAAAGACAACTCTGCAT
GTGCCTGTGTGAATGTGTGCATCCATGGAGTATTTCCCAGGTAAATACTAGTACTGGGGACATAGGCTAA
TTGTGTGTCCCACACTGCAAGATGCTAGGGCGTAGTTAACACTGTGGTATACATACAAATCAGGCACTGT
CCAAAAGATTTTTTAAAATCTAAAGTCTGAAATGTAAAAATATAAGGTCTCAACCCACTTTTACACTTTT
AAAGAGATCCCATACCTGTTTCACTGACTGCCGTTAATTACACTTTTGGATCACAGCTGGTTAAATTGAT
AGATTTCAGTTTATCTCAGTGAATTTTAGAATGGAGATTATAGCATTTTTAATTGGAGAACAGACATT
TCCTAAAGTATATGAAAAAAAATTATTCACTGTTGGTTTAAACCAGTATCTTTGTATGAGTGCCAAAGAT
ATATGAACACAGATACTGCCTGTGCAGACCTAAATTTTAGTTTTGTGTACCTGGATCCATATACAAATTT
TTTGTGGTTTATAGCATAAAAGCAGAACGTTGTTTCTTCTTAGTTTTCAACCGGCTCATCTTTTGTTTT
TGTTTTTTGTTTTTTGTTTTTTGTTTTTTTGAGATGGAGTCTTGCTTTGTTGCCCAGGCTAGAGTGCA
GTGGCACAATCTCTGCTTACTGCAACCTCCACCTCCGGGGTTCAAGTGATTCTCCTGCCTCAGCCTCCTG
AGTAGCTGGGACTACAGGCGCGCACCACCATGCCCGGCTAATTTTTGTATTTTTAGTAGAGATGGGGTTT
```

Figure 20 (Continued)

```
CACTATGTTGGCCAGGCTGGTCTCGAACTCCTGACCTCGTGATCTGCCCACCTCAGCCTCCCAAAGTGCT
GGGATTACAGGCGTGAGCCGCCATGCCCGGCCAATTTTCAACTGGCCCATACTTTATAGTGATGGAAAGC
GCATAAACTACTTGTAAATCATTAAAATAGGGTGATAACTGTGATAATAGTGTTTCTTGCATTCTAGAAA
ATTATTTTATTAACTACATTCAAAACCCAGCATTTCACAGGTTCCATCATTAGAAACAGTATAGTTCTAG
TTAACATGATTGGAGAGTTTCAGGGGAAAGGTTTACATTTTCTGAAACTGTATTTGGTATGTGACTCAAT
GTGGTATTTCAGTCTTGTTAGTCACTTACATGACTGACGTTTGCAAGGATTTATTGCCAAGTAAAATTTG
ACCAGAGTGCACTGAGAATAGCTACATAAGGGGAAATCTCTCAAAATTCCTTCTGTTCATTTAATTTGGA
GCATATTGTTTAAATCATTTTAAACATATGTAAAAAGTTGAAGCATTAAAAAATCTTCAAGAAACAATGA
AAAAATAGAAATTAGCAAACATAAGTTTCTTAATGCAAAATTAATAGTGAATAAAATATAGCCTACATTA
AAAGCCAGAGGCTTTGCTATAAATATAAGAGTTTAGAAAAACAGTGTGCTTCAATTAAGGACTAAATTAT
CAAAACTGCATGTTTGTTTTTCTTTTCTTTTCTTTTTTTTTGAGATGAAGTCTCACTCTGTTGCCCAG
GCTGGAGTGCAGTGGTGCGATCTTGGCTCACTGCAACCTCTGCTTCCCAGGTTCAAGCGATTCTCGTGCC
TCACCATCCCGAGTAGCTGGGATTACAGGTGCACCACACCATGCCCAGTTAATTTTTGTATTTTTAGTAG
AGACAGGGTTTCATTATTTGGCCAGGCTGGTCTCGAGCTCCTGATCTTAAGTGATCCACTCGCCTCGGCC
TCCCAAAGTGCTGGGATTATACACATGAGCCACTGTGCCCAGCCTAAAACTACATGTTGAAGCTTCCGGT
CATTTCCATTATTATCCTTCTTTTGAAATTCAAGTTAGTGCTTTTTAACCAAATAAAAGAAGAACCAGCT
CTTGGGATATGTGACTCTGCCTCTGTATAAAGTGACTGGAATTTTGTTAAAACCGTGTTTCCACTTCTGA
ACCCTGTTACCATTCCCCCTCACAAATCCCCACCCAACACCTGGATTTTAAAGATCCTCCAGTGTCAAGG
GAAGCCACAGAGTCTATTAAAGAGGCAGTTCTGAACCAATTAATTTTTGTCCTTATAATTTAGAGCATTA
AATAGCTAATATATTTAATGGCACTAATTGTTGTTCACGGCTTTCATCATACTTTTAAACAGAATCCAAA
GTATTCAAAGGAAAGTAAGCGAAGTTATCCAAAGCCAACTTTGTTTCAGGTGTGTCCCCTGCCCCAAATA
GATTTTAGGGCAGAAATAGAAAACTGAGTTTACACAGAACTATTTTTGGAAAAGCTGCACTGGAGTAGAT
GGATTCTTCTTCAGCATACTTTTTTGTTTGTTTGTTTGAGATGGAGTCTTGCTTTGTCACCCAGGCTGGA
GTGCAGTGGTGTGATCTCCACTCACTGCAACCTCCACCTCCCAGCTTCAAGTGATTCTCCTGCCTCAACC
TTCCAAGTAGCTTGGATTACAGGCGTGCGCCACCACAGCTGGCTAATATTTGTATTGTTAGTAGAGACAG
GGTTTCACCATGTTGTCCAGGCTTGTCGAACTTCTGACCTCACGTGATCCACCTGCCTCAGCCTCCCAAA
GTGCTAGATTATAGGCGTGAACCACTGCGCCCGGCCAGCATGCATTTTAAAAGTGGCTTAGATTTAGTTT
TAAATATTTTGGGGTGAAAGGCAGGAACAGTTCTGTTTTTGACATACAGGTTTTCTTTGGGATTGTTTTC
ATTTTCAAGTATAGATTCATGTCAGAATGGCCAACTTAACGTGGGTTTCTGTATTCCCTGGTGTTGCTCT
TAACCTGAACTCATAATCAGTTGCCATACTGAGGCAAGAGCACTCAGGGTGAACATAGTCAAGTTACTTT
AAAAGTGATAAAAGTGTTTTTCCATGGTGAAACCTTCAGTATTTGGCTGAATGTAAAGTATGTTGAAGTG
GTATATTGATGGTAAGTTGTTAATCACTAACCTTGTTTGCACTTTTGTACACCACTGCTTGCACTAGGAT
CTTGGTGTGAATTTTCAATTGTTTTACAGTGTATACAGATTATTAAGGATAATTTATATAAAGATGTTTC
TGTTTAACTTTGTGTGTTTTACAACAAAGAGCTATAATAGATGGTTAAACGTTTTTGAATTGTGTTTATA
TGTTAGTTTGATTATGTTCTATTATCTTTTCACCTGCCATGAATTTGAGTGTTAGGAAGGGAAAAATAAA
ATACTAATCTGGTCTTGAAGAA

>gi|50345274|ref|NM_016185.2| Homo sapiens hematological and neurological
expressed 1 (HN1), transcript variant 1, mRNA
GGCTTAGGCTGAGCCGTGGCCGCCACAGCCCATCGTAATGCCGCATGGTGCTTGGCACTCCAGAGAGCCA
ATAGGAATGAAAGAATTCATTTGAATCGGCCAATGCCGGCGGGTTAGGGGCGGGGGTTGAAAACCCTAT
AAAGGCGTCGATCGGCCGGACAGGCGGCAGCGGCGGCTCCTGCAGCGGTGGTCGGCTGTTGGGTGTGGAG
```

Figure 20 (Continued)

```
TTTCCCAGCGCCCCTCGGGTCCGACCCTTTGAGCGTTCTGCTCCGGCGCCAGCCTACCTCGCTCCTCGGC
GCCATGACCACAACCACCACCTTCAAGGGAGTCGACCCCAACAGCAGGAATAGCTCCCGAGTTTTGCGGC
CTCCAGGTGGTGGATCCAATTTTTCATTAGGTTTTGATGAACCAACAGAACAACCTGTGAGGAAGAACAA
AATGGCCTCTAATATCTTTGGGACACCTGAAGAAAATCAAGCTTCTTGGGCCAAGTCAGCAGGTGCCAAG
TCTAGTGGTGGCAGGGAAGACTTGGAGTCATCTGGACTGCAGAGAAGGAACTCCTCTGAAGCAAGCTCCG
GAGACTTCTTAGATCTGAAGGGAGAAGGTGATATTCATGAAAATGTGGACACAGACTTGCCAGGCAGCCT
GGGGCAGAGTGAAGAGAAGCCCGTGCCTGCTGCGCCTGTGCCCAGCCCGGTGGCCCCGGCCCCAGTGCCA
TCCAGAAGAAATCCCCCTGGCGGCAAGTCCAGCCTCGTCTTGGGTTAGCTCTGACTGTCCTGAACGCTGT
CGTTCTGTCTGTTTCCTCCATGCTTGTGAACTGCACAACTTGAGCCTGACTGTACATCTCTTGGATTTGT
TTCATTAAAAAGAAGCACTTTATGTACTGCTGTCTTTTTTTTTTTCTTTTGAAGAACAGGTTTCTCTCT
GTCCTTGACTCTTGGGTCTGTGGGCCATGGCATGAGTGTTTTCTAGTAGTAGATTGGAGGGAAAGCTTTG
TGACACTTAGTACTGTGTTTTTAAGAAGAAATAATTTGGTTCCAGATGTGTTAGAGGATCTTTTGTACTG
AGGTTTTTAACACTTTACTTGGGTTTACCAAGCCTCAACTGGACAGACCATAAACAGTCCACAGGCACCG
TTCCTGCCAGGCCCCAACCCACAGGGAGTCTCTCCGCAGAGCCTTCTTGGTGTTGCCCTAACTTGCCAGT
GGCCTTTGCTCAGAGCCTCCTCCTGTGACATGTGAACAATGAAGAGGCCTGCGCCTCCTGCCTTGCCGCC
TGCAAAGCAAAGAAACTGCCTTTTATTTTTTAACCTTAAAAAGTAGCCAGATAGTAACAAGACTGGCTGG
CTGATGAGCAAAGCCTTTGCTCTCACGCAGAGGAAGGCTTGGATGTACAATGAAACTGCCTGGAACTAAA
AGCAGTGAAGCAAGGGAGGCAATCACACTGAAGCGGGTCTTCCTCCAGGAACGGGGTCCCACAGGCGTGT
TGTTTTAAATAACCTGATGCTGTGTGCATGATGCTGGTGCTTGACCATGAAAGGAAAGTCTCATCCTTAA
AATGTGTTGTACTTCACAATCCTGGACTGTTGCTTCAAGTAAACAATATCCACATTTTGAAA

>gi|209571485|ref|NM_016322.3| Homo sapiens RAB14, member RAS oncogene family
(RAB14), mRNA
GCTTTCCACCTTCCCTCCGGGCGCGAGCGCCCGTGGGGCGGGCCTCAGCGGCGGCGCGACAAGTCCAGAG
GTGAGGGCTGAGGAAGGGGCGTGGCTAGCGGGCTGGCCTCAGCCACCCTCTTCCGGGCTCCGCCAGCTGC
GCGCGCATCTTCTCCCCCTTCTTTTGTGGTCCGGCCCATTGCGAGGGTGACAGGAAACCCTGTGCAGGGA
GCGCCGCCATCTTGGACCAGCCCGAGGAAGATACTGAGGGAGCACAGGAGCAGTCACCGCTGCCACTGCT
ACTGCCGCTACTGCTGCCGGCGCGTCTGCACCTCTCGGCCTGCCAGTGTACCTGCCGGCGCCTCGGTCGA
CCGCCCCGCCCCCTCTCCCGCTGCGTCCGCACTCCTGTTCCTGGTCCTGACGCCCCCTCCCGCCCGGA
AAGCTGCCCAGCCACCAGCAACCCCCAGTGCCACCATGGCAACTGCACCATACAACTACTCTTACATCT
TTAAATATATTATTATTGGGGACATGGGAGTAGGAAAATCTTGCTTGCTTCATCAATTTACAGAAAAAAA
ATTTATGGCTGATTGTCCTCACACAATTGGTGTTGAATTTGGTACAAGAATAATCGAAGTTAGTGGCCAA
AAAATAAAACTGCAGATTTGGGATACGGCAGGACAGGAGCGATTTAGGGCTGTTACACGGAGCTACTACA
GAGGAGCTGCGGGAGCTCTTATGGTCTATGATATCACTAGAAGAAGTACATATAACCACTTAAGCAGCTG
GTTGACAGATGCAAGGAATCTCACCAATCCAAATACTGTAATAATTCTCATAGGAAATAAAGCAGATTTG
GAGGCACAGAGAGATGTTACATATGAAGAAGCCAAACAGTTTGCTGAAGAAATGGCTTATTGTTCCTCG
AAGCGAGTGCAAAAACGGGAGAGAATGTAGAAGATGCCTTCCTTGAGGCTGCCAAGAAAATCTATCAGAA
CATTCAGGATGGAAGCTTGGATCTGAATGCTGCTGAGTCTGGTGTACAACACAAACCTTCAGCCCCGCAG
GGAGGCCGGCTAACCAGTGAACCCCAACCCCAGAGAGAAGGCTGTGGCTGCTAGTGACCTCTTTGCTGTG
GCCCCTCATTTGACCTTTCACCTCTGTCTGTTGGAAGCAGTACTTTTTACTGCCTCATTGTCTTCTGTAC
ATCTTACTGGGTTTAATTAAAAAAAAAGAAAAAACTCTGTTGTAAAAACAGTTTAACACAATACTAAACT
GCTAAACAACTAGATGTAATCAGGTTATCAAAGGCAAGTAGAGTAATAAATCTCTCCTGCATGGTAAATC
```

Figure 20 (Continued)

```
TAGACTTTTTTTCCCCCTTGTCCTCGTGATAAGTATGTCACCAATATATGATTTAAACCGAGCACTGATG
CTGGACTTCATGATTTTTACCCTCCCTTTGGCAAGGCTTTGTCTCACTGTACGGTTTAATTTGGTGATAT
CTTAAGCCTTTCTTCCCATCCTTAACTGTTCAAGTATGTCTGTTGTAACCAATAAGTTTATTGCTGTGAA
ATTACTTCTGATGGTAGAGAAGGGGTTCTATAACTGCTTTTGTTTTGTTTTGGATAAATTTCCTGTTGTG
TGGGTGGCATTTTTCTTAACGAGATTTGCTTCTGTCTTAGCCTCACACAGGGAAAATATCCATTTATCTT
CTCTCTCGTGCTTAATTAATAGCTTTATCTTTTTTTATACCATTTTATCCTTTTCTCTTTAACAGAAAGT
AAATATGTATAAAATTTGAAGGAATCGAACTAACAATACATTCTGTGTATATTATTTTAATGAAGAAAAT
AAATTGATTACTGGCATTGGAACAGTATAAAATACCAGTTTGTACAGTATGACCTATATGTGACCATGTT
ACTCCCTTCCATTTCACACAAAGAAATAGACACAACTGCAGTTCACAAGTAGTACTGGCTCCACCCCTTG
GTGCTGGCAGTGTTTGGGGACATTATGCTGGAAAGAGCTCCTAGCATCAGAGGATTAACACTAGCAGATT
CTGTTCCATCTTTGCACTGTTGCTTACCTGCTGATTTTCTTAACTGTTCTTGTGCAATCGACAATGTGCT
AACCTGCTTTTCTCTTTTTGTAAACGTTTTTGCATTACAGGCTGCATTCTTGCCTTACTGTATAGAAAAA
GAAAAAAGGCTGGGTTTACTATTGCACATTTTAAGCTTTTATACCTTTATCTTCTTGGAATGGTCAGATT
CTGAACTGGACAGTCAGAACCACAGGTCTGCTGTTAAGGGATTTTAAATTGTGCATTTTTAACCCTACAG
TGAAATAACTTAAGATATCCCTGTGTTCACAGTGTGAGGGGCTGTTTTATGTCATGTTGGCATAAATTGT
TTTGTAAAAGGGAAAGTGTTTCTAAAGGTGTTTCAGCGCTTGTGCTGATACAAAGTAAGTTATTACTTTG
CACCAGGTGGTTTGGCCACTGAATTAATACTGTATAGCAAGAGAAACAATCTTATTTTTTGGACAACAT
GTTTTATTAAGTTCTTCATTTCTGTTGATTTTTTTATTGCATTTATGATTCAGTGGCTGGGAATTGAGA
ATTTATTTGAAATAGAATAGGTAACACCTCAGCGTACTATAGAAAATGCACTCAGCTCAACTGCTGTGTT
TAAAATACACATTTTAAATCCCTCTTTACAGACACTAACATAAAAGTACATCTTTCTGGGTTGTAAACAT
GTGGTAGTACCAGAGTATTGTATAGTCAATGTTAAATAAAAGCCAAAACTGGAATGTGCAGAAAGTAGGC
TTTGGTTAATTTGTGGATTCATTTTTATTTTTGTCTTTGTTTAACTTTTTAAAAAATAAGATTTCTGGAG
TAGATTGGTATATTCTGTTAAAGACTTACAGTGATCCATTTTGCTTACACTGTTGCATCACAAGGGACTC
ACCCAGGGACCATGACCTGCTGGTGTGTGTATATTTACAAAAACAAAACAAACAAACCACCCATTGGG
ATATAAGGTAGCAATCACAAACTAAAGACTGCGGCTTGTTGAGGTGCAATACCCTGACTCCCAAAGTTAG
TTACAGTGGGTTTTATTGTTTTGTGACTGAAGGATTTATTCAGACTGCTGTACTCTTCATTTGATGTAA
CAAAATGCTATTAATCTAAATATTTGTAAATAAAGTACCTGTATCTAGATTAAATTAAAATTGGTTGCAT
TATTTTCTGAACTATAATAGGGTTTTTCTTCAGGTGAACAATTTGACGTGTCATCAGTTTTTATTGCAGC
ACTGTCCATATTCATTGTATAAAGAGAGGTCTACGTATGTAGCATATAAAACCACATCACTAAGTAATAG
ACCCACAGCTTTATTCTTGTGTTTACATTACCCTTGAAATGTTTTCAGTCAACCCTTTTCAGTGTAAGAT
CAGCACATTTGGTGGCTGATGCTGTTCTCCTTTGACTGTACCGGGAGCCAGATTCTATCATATGCATGTG
TAATCCCCTGTAATACACTCAGGTGCTCACAAATAGAGCAGATTGTCATATTGTAACATGCGTGTGCCAG
ACACCGGGCAGTACACTTTGGAAAGAATGTGAAATCCTTTTAATTTTTAATCCATAGCTTACTGCTTGTG
CAGTCACCTGCCTCTTGAGGTTGCTCATTGCCCTTGGACCTGTGAGGAGGCCTTCAGATTAGTAATTGGT
GCTTAGTACTATTTATGCTTAAATAGATCTTCCAGTACAATGTTGAAGTCTTTTTTATGGATAATAACGT
GTTTGATGGAGTAACTTATTATTTTTTTTGGTTGGTGGTTTACACGTTAATAGAGGTAGTACAATTTCT
TTGGAAAGGTGTCTTTTGAAGCCAGCTGTTAAGCTTCATACATTACCTCCCTTCTCAAATTCGGTAAGAC
AGTAGTTTTGGGGAACTTTTTTGCCCATGTGTCTTTTAAGTGTGATTTTAAAAAAATGAGTGGTTCAGTT
CATTCCCCTAAACAGAAGAAAAGACCAAATAATTACCTTCCATTCCTCTTCATGTGGGAATATAGAGAGG
GTTCATGTGGCATTTTAGAGAAAAGATAATTTATCCTCATTCAACACAGGCCCAGAAATTGTGTCCCAG
AAGGATGTCAGTAATTGTGACTAGGCCAGGCCTTTTAGCATTTGCTAAGACTTGAAACAAAAAATGTAA
ATACAAAAGAAATCAAGTTTTGTTTTGAAAGATGCCTTCTAGAACTTACTGTGTATTAATAAATTGTCAC
```

Figure 20 (Continued)

TTTCATTGTCTTTATTGTAACTCCATTGATCCCGTATCTTAACGGTTCACGTCTAGCCAAATAACTGTTT
TGGAATAAAAACCTTGGTGGTGAAAAAAAAAAAAAAAAA

>gi|42516575|ref|NM_016417.2| Homo sapiens glutaredoxin 5 (GLRX5), nuclear gene
encoding mitochondrial protein, mRNA
AATGAGGGCCTCCAGGGGCGGGTCGGACTGCCGCGGGCCGGGGAGCGCTCTGGGTGGCCAGCTGTGGGC
CCGGGCCGTCGTGGGCTCCGGCTTGCGTGCGGAGATGAGCGGGTCCCTCGGCCGAGCTGCGGCGGCTCTG
CTCCGCTGGGGGCGCGGCGCGGGCGGCGGTGGCCTTTGGGGTCCGGGCGTGCGGGCGGCGGGCTCGGGCG
CGGGCGGCGGCGGCTCGGCGGAGCAGTTGGACGCGCTGGTGAAGAAGGACAAGGTGGTGGTCTTCCTCAA
GGGGACGCCGGAGCAGCCCCAGTGCGGCTTCAGCAACGCCGTGGTGCAGATCCTGCGGCTGCACGGCGTC
CGCGATTACGCGGCCTACAACGTGCTGGACGACCCGGAGCTCCGACAAGGCATTAAAGACTATTCCAACT
GGCCCACCATCCCGCAAGTGTACCTCAATGGCGAGTTTGTAGGGGCTGTGACATTCTTCTGCAGATGCA
CCAGAATGGGGACTTGGTGGAAGAACTGAAAAAGCTGGGGATCCACTCCGCCCTTTTAGATGAAAAGAAA
GACCAAGACTCCAAGTGAGGGCGGCCAAGTCCTCGCTGAGCAGAGAGGGAGCCGTTCATGTCAGAGACTC
ACTGCCAGAAAAGCCTTACCCATTTTGGTTTTCACTATTGAGACCGCAACTGCTTGCACTGATCATTTTG
GTTCGTGAGCAGTTGGTGATTTAGTTGGTCTGGTGTTCGGGCTAAGAATATTTTATTGTGGACTTAATT
ACAACCACTGCACTGTAATGATTCAATGCTGTATTATGATATTGCTGTAAACAAAATTCATTCTTATATT
GTCACTTATTCTTTGCCTGATTCAGAAGTTAAATAGGAGCTTTGGAATCATTATTCATGACCCCTCTGCA
AATGTGTCAGTCTCCAAAGAGAGTATCTCCCCCCAAATTTTGTGTAGCTTCTTTTGTTATGGAAAATGGT
GAACAAAAAAGAAACTGTGATAACTGGGGCGTTGTTTTTTAAAATAAACTCCAGCACAGGGATGCTGTG
CATGCCTGAGTTGATTCCGAAGTGCATATGTCTGTAAGGATTTGGAGTGCCTGCAGTGTTTTATGTGTGG
GAAGTAAGGGTGAGTCTCATATTCTTCTATTAAATTTGCCACAAGAATTGCAAAAAAAAAA >gi|166064024|ref|NM_016508.3| Homo sapiens cyclin-dependent kinase-like 3
(CDKL3), transcript variant 2, mRNA
GGAACTACGCAGAGCCAGACCAGCGGGACCACAGAATGGGCTGAGGCGGCGGCGGCTGTTTGGATAAAGT
CAACAGCGGGACGTGGGCGTGACGCCGTAGTAAAAGCCCAGCTTGAAAATGGAGATGTATGAAACCCTT
GGAAAAGTGGGAGAGGGAAGTTACGGAACAGTCATGAAATGTAAACATAAGAATACTGGGCAGATAGTGG
CCATTAAGATATTTTATGAGAGACCAGAACAATCTGTCAACAAAATTGCGATGAGAGAAATAAAGTTTCT
AAAGCAATTTCATCACGAAAACCTGGTCAATCTGATTGAAGTTTTTAGACAGAAAAAGAAAATTCATTTG
GTATTTGAATTTATTGACCACACAGTATTAGATGAGTTACAACATTATTGTCATGGACTAGAGAGTAAGC
GACTTAGAAAATACCTCTTCCAGATCCTTCGAGCAATTGACTATCTTCACAGTAATAATATCATTCATCG
AGATATAAAACCTGAGAATATTTTAGTATCCCAGTCAGGAATTACTAAGCTCTGTGATTTGGTTTTGCA
CGAACACTAGCAGCTCCTGGGGACATTTATACGGACTATGTGGCCACACGCTGGTATAGAGCTCCCGAAT
TAGTATTAAAAGATACTTCTTATGGAAAACCTGTGGATATCTGGGCTTTGGGCTGTATGATCATTGAGAT
GGCCACTGGAAATCCCTATCTTCCTAGTAGTTCTGATTTGGATTACTCCATAAAATTGTTTTGAAAGTG
GGCAATTTGTCACCTCACTTGCAGAATATCTTTTCCAAGAGCCCCATTTTTGCTGGGGTAGTTCTTCCTC
AAGTTCAACACCCCAAAAATGCAAGAAAAAAATATCCAAAGCTTAATGGATTGTTGGCAGATATAGTTCA
TGCTTGTTTACAAATTGATCCTGCTGACAGGATATCATCTAGTGATCTTTTGCATCATGAGTATTTTACT
AGAGATGGATTTATTGAAAAATTCATGCCAGAACTGAAAGCTAAATTACTGCAGGAAGCAAAAGTCAATT
CATTAATAAAGCCAAAAGAGAGTTCTAAAGAAAATGAACTCAGGAAAGATGAAAGAAAAACAGTTTATAC
CAATACACTGCTAAGTAGTTCAGTTTTGGGAAAGGAAATAGAAAAAGAGAAAAAGCCCAAGGAGATCAAA

Figure 20 (Continued)

GTCAGAGTTATTAAAGTCAAAGGAGGAAGAGGAGATATCTCAGAACCAAAAAAGAAAGAGTATGAAGGTG
GACTTGGTCAACAGGATGCAAATGAAAATGTTCATCCTATGTCTCCAGATACAAAACTTGTAACCATTGA
ACCACCAAACCCTATCAATCCCAGCACTAACTGTAATGGCTTGAAAGAAAATCCACATTGCGGAGGTTCT
GTGACAATGCCACCCATCAATCTAACTAACAGTAATTTGATGGCTGCAAATCTCAGTTCAAATCTCTTTC
ACCCCAGTGTGAGGTGAGCTGTAACAGAGAAGAAACCTAAATAATACAACATTCCTGTATAATGGTATTT
CAAAGAATCGTGTTCATAGTGTCTGTATGTAAACTGAACTTGAAGAAAATATATTGAAATTAAAGCTGTA
TAATGGGCCAAAAAAAAAAAAA

>gi|42544234|ref|NM_016630.3| Homo sapiens spastic paraplegia 21 (autosomal
recessive, Mast syndrome) (SPG21), transcript variant 1, mRNA
GGAGTCTCGCGCCAGCTGAGCGGCGGTCGGGCGGGGGGAGCGCGGCGGCCCAAGCTCGCTCGGCCACGCG
CCCCGCCCCCTCAGAGGCCGGCCTCCCGCACGCACCGCGCAGCCTGCTGTGCCCGTGGGTCCCGAGTGCT
CCGCCGCCCGCCCCGACCCGGGCCCAGCCGCCTCCACGGCCCGCGCTCGTACTGGAGCGAAGAGCGGCCT
CCTGAAGGAGGGGAAGGGACGTGGGGCGGCCACGGCAGGATTAACCTCCATTTCAGCTAATCATGGGAG
AGATTAAAGTCTCTCCTGATTATAACTGGTTTAGAGGTACAGTTCCCCTTAAAAAGATTATTGTGGATGA
TGATGACAGTAAGATATGGTCGCTCTATGACGCGGGCCCCCGAAGTATCAGGTGTCCTCTCATATTCCTG
CCCCCTGTCAGTGGAACTGCAGATGTCTTTTTCCGGCAGATTTTGGCTCTGACTGGATGGGGTTACCGGG
TTATCGCTTTGCAGTATCCAGTTTATTGGGACCATCTCGAGTTCTGTGATGGATTCAGAAAACTTTTAGA
CCATTTACAATTGGATAAAGTTCATCTTTTTGGCGCTTCTTTGGGAGGCTTTTTGGCCCAGAAATTTGCT
GAATACACTCACAAATCTCCTAGAGTCCATTCCCTAATCCTCTGCAATTCCTTCAGTGACACCTCTATCT
TCAACCAAACTTGGACTGCAAACAGCTTTTGGCTGATGCCTGCATTTATGCTCAAAAAAATAGTTCTTGG
AAATTTTTCATCTGGCCCGGTGGACCCTATGATGGCTGATGCCATTGATTTCATGGTAGACAGGCTAGAA
AGTTTGGGTCAGAGTGAACTGGCTTCAAGACTTACCTTGAATTGTCAAAATTCTTATGTGGAACCTCATA
AAATTCGGGACATACCTGTAACTATTATGGATGTGTTTGATCAGAGTGCGCTTTCAACTGAAGCTAAAGA
AGAAATGTACAAGCTGTATCCTAATGCCCGAAGAGCTCATCTGAAAACAGGAGGCAATTTCCCATACCTG
TGCAGAAGTGCAGAGGTCAATCTTTATGTACAGATACATTTGCTGCAATTCCATGGAACCAAATACGCGG
CCATTGACCCATCAATGGTCAGTGCCGAGGAGCTTGAGGTGCAGAAAGGCAGCCTTGGCATCAGCCAGGA
GGAGCAGTAGTGTGTCTCTCGCTGTCAATGATGAGTTGACCCGGTGTGTTCTTGTATAGTCAGTGGCATC
AGCACCCGTCAGCCGGCCTTTTCCTTCAGGTTCGTCAGGCTCACCGGTTCTCACTGTGTCTGGGAAGTAG
GACTGATGGTCATCTTCATGACAGGCGGCATCTCCACTAAGCCTGTGTAACTGTTCCCTCTTTGGTTTTC
TTAGCTTTTGAATTTGAAGAAGTACTTTTGAAGACTCCCATTTTAAGAACCGTGCAGATTTTGCTACCAA
AAGTCTTCACCACTGTGTTCTTAAGTGAATGTTAATTTCTGAGGTTTGGGACTTTGTGGTGGTTTTTTTC
TTCTTTTCTTTTCCATTCTTCTTTCTTTCTTTTATGTTGTTTGCTGTAAATGCTGCACATCCAGATTGC
ATATCAGGACATTGGTTATTTTATGCTTTCTTGGATATAACCATGATCAGAGTGCCATGGCCACTACCCC
ACTGTTTGCTCTCCTGCAAATCAACTGCTTTTAATTTACACTTAAACAAATTGTTTTGAGTGTTAGCTAC
TGCCTTTCTAGATATTAGTCATTTGGAATAAAAATTCAATTTCACTGAAAAAAAAAAAAAAAAAA >gi|21614516|ref|NM_016815.2| Homo sapiens glycophorin C (Gerbich blood group)
(GYPC), transcript variant 2, mRNA
GAGCCCCTCCCCTCGGCCCGCGCGGGAGGAGTGTGACCCAGGTGCCGCTTCCTCTCGCCGCCGAGGGTCA
GGAGCCCGGGAGCGCGACCCTCCCCCGGCCCGGCCTGGCCCGGCCTGGCCAGTCCCCGCGGTCTCTGCCC
GGGCTGACGCCCAGGAATGTGGTCGACGAGAAGCCCCAACAGCACGGCGTGGCCTCTCAGCCTCGAGCCT

Figure 20 (Continued)

```
GATCCAGGGATGTCTGGATGGCCGGATGGCAGAATGGAGACCTCCACCCCCACCATAATGGACATTGTCG
TCATTGCAGGTGTGATTGCTGCTGTGGCCATCGTCCTAGTCTCCCTCCTCTTCGTCATGCTGCGCTACAT
GTACCGGCACAAGGGCACGTACCACACCAATGAGGCCAAGGGCACGGAGTTTGCTGAGAGTGCAGATGCA
GCCCTGCAGGGAGACCCTGCCCTCCAAGATGCTGGTGATAGCAGCAGAAAGGAGTACTTTATTTGAGGGA
CAACAGACTTCACTTCCCTGAATGCCTCCCCCATCTCCATCAGGAAAAATACACCCCATCGCCCAGCACC
CCTGCTGATACCACCAGACAGAGAGAGAGAGCACTTGATTCTTCCCGAGATAGCCACCTGGAAACACTAG
GTGCCTGCCCAGGGAGGAACGGAGGAGGACTCGCGCTACAAGAGGCCACTCCCAGGGACCCAGGGAGGCG
ATGGCCACCCCAGAGGCCACCTTTTGCTCCACGGAGGTGGGAGAAAATCTGGGCACATGGGGCCCCCTGG
GCAGTGCAGGACAACATCAGCTCACTGGCAGGAAAGTCCTTGTTGAGGGTGAGGGGGTGCTGGGGTACCC
GGGGGCTGGGGAAGCAAGGAAATAAGTCATCTGTATGCTGACTGGGGATAATGGCATCAAATGTCAGTCC
TTGACATTTGGGGGGAACAGCAGGTGCCAGAGCTAAAAGGTACCTTTGTCTGCCATTGATCCAGCTCAGA
ACGATTGGAAATAAATTTGAAATGTAACCGAGCAAAAAA

>gi|196115210|ref|NM_017411.3| Homo sapiens survival of motor neuron 2,
centromeric (SMN2), transcript variant d, mRNA
CCACAAATGTGGGAGGGCGATAACCACTCGTAGAAAGCGTGAGAAGTTACTACAAGCGGTCCTCCCGGCC
ACCGTACTGTTCCGCTCCCAGAAGCCCCGGGCGGCGGAAGTCGTCACTCTTAAGAAGGGACGGGGCCCCA
CGCTGCGCACCCGCGGGTTTGCTATGGCGATGAGCAGCGGCGGCAGTGGTGGCGGCGTCCCGGAGCAGGA
GGATTCCGTGCTGTTCCGGCGCGGCACAGGCCAGAGCGATGATTCTGACATTTGGGATGATACAGCACTG
ATAAAAGCATATGATAAAGCTGTGGCTTCATTTAAGCATGCTCTAAAGAATGGTGACATTTGTGAAACTT
CGGGTAAACCAAAAACCACACCTAAAAGAAAACCTGCTAAGAAGAATAAAAGCCAAAAGAAGAATACTGC
AGCTTCCTTACAACAGTGGAAAGTTGGGGACAAATGTTCTGCCATTTGGTCAGAAGACGGTTGCATTTAC
CCAGCTACCATTGCTTCAATTGATTTTAAGAGAGAAACCTGTGTTGTGGTTTACACTGGATATGGAAATA
GAGAGGAGCAAAATCTGTCCGATCTACTTTCCCCAATCTGTGAAGTAGCTAATAATATAGAACAAAATGC
TCAAGAGAATGAAAATGAAAGCCAAGTTTCAACAGATGAAAGTGAGAACTCCAGGTCTCCTGGAAATAAA
TCAGATAACATCAAGCCCAAATCTGCTCCATGGAACTCTTTTCTCCCTCCACCACCCCCATGCCAGGGC
CAAGACTGGGACCAGGAAAGCCAGGTCTAAAATTCAATGGCCCACCACCGCCACCGCCACCACCACCACC
CCACTTACTATCATGCTGGCTGCCTCCATTTCCTTCTGGACCACCAATAATTCCCCACCACCTCCCATA
TGTCCAGATTCTCTTGATGATGCTGATGCTTTGGGAAGTATGTTAATTTCATGGTACATGAGTGGCTATC
ATACTGGCTATTATATGGGTTTTAGACAAAATCAAAAAGAAGGAAGGTGCTCACATTCCTTAAATTAAGG
AGAAATGCTGGCATAGAGCAGCACTAAATGACACCACTAAAGAAACGATCAGACAGATCTGGAATGTGAA
GCGTTATAGAAGATAACTGGCCTCATTTCTTCAAAATATCAAGTGTTGGGAAAGAAAAAAGGAAGTGGAA
TGGGTAACTCTTCTTGATTAAAAGTTATGTAATAACCAAATGCAATGTGAAATATTTTACTGGACTCTAT
TTTGAAAAACCATCTGTAAAAGACTGAGGTGGGGTGGGAGGCCAGCACGGTGGTGAGGCAGTTGAGAAA
ATTTGAATGTGGATTAGATTTTGAATGATATTGGATAATTATTGGTAATTTTATGAGCTGTGAGAAGGGT
GTTGTAGTTTATAAAAGACTGTCTTAATTTGCATACTTAAGCATTTAGGAATGAAGTGTTAGAGTGTCTT
AAAATGTTTCAAATGGTTTAACAAAATGTATGTGAGGCGTATGTGGCAAAATGTTACAGAATCTAACTGG
TGGACATGGCTGTTCATTGTACTGTTTTTTCTATCTTCTATATGTTTAAAAGTATATAATAAAAATATT
TAATTTTTTTTAAATTAAAAAAA >gi|197387274|ref|NM_017503.3| Homo sapiens surfeit 2 (SURF2), mRNA
AGGTTCTGCGAGCGGCTTCCGCCGGGCTGCTCCGCGGGCGCGTCGGCCATGAGCGAGTTGCCGGGCGACG
```

Figure 20 (Continued)

```
TGCGGGCGTTTCTGCGGGAGCACCCGAGCCTGCGGCTCCAGACGGACGCCCGCAAGGTGAGGTGCATCCT
GACAGGTCACGAGCTGCCCTGCCGCCTGCCGGAGCTCCAGGTCTACACCCGCGGCAAAAAGTACCAGCGG
CTGGTCCGCGCCTCCCCGGCCTTCGACTATGCAGAGTTCGAGCCGCACATCGTGCCCAGCACCAAGAACC
CGCACCAGTTGTTCTGCAAACTCACCCTGCGGCACATCAACAAGTGCCCAGAACACGTGCTGAGGCACAC
CCAGGGCCGGCGGTACCAGCGAGCTCTGTGTAAATATGAAGAATGTCAGAAGCAAGGGGTGGAGTACGTG
CCTGCCTGCCTGGTGCACCGGAGGAGGAGGAGGGAGGACCAGATGGACGGTGACGGGCCTCGCCCGCGGG
AAGCCTTCTGGGAGCCCACATCCAGTGATGAGGGGGAGCTGCAAGTGATGACAGCATGACAGACCTGTA
CCCACCTGAGCTATTCACCAGAAAGGACCTTGGAAGCACGGAGGATGGGGATGGCACTGATGACTTTTTG
ACAGACAAAGAGGATGAGAAGGCAAAGCCCCCAAGAGAGAAGGCCACTGATGAGAGCAGGAGAGAGACGA
CCGTGTACCGAGGGCTGGTCCAGAAGCGCGGGAAGAAGCAGTTGGGCTCGTTGAAAAAGAAGTTCAAGAG
TCATCACCGCAAACCCAAGAGCTTCAGCTCCTGTAAACAGCCAGGTTAATAAAAGCACATGCCGTGAAGT
TTCG

>gi|296434230|ref|NM_017566.3| Homo sapiens kelch domain containing 4 (KLHDC4),
transcript variant 1, mRNA
ATTTCTGTGCGCCGAGCTCCGCCCCACGAGCACCTGTTTCCGAGCGGAGAGCGCGGGCCGTTTTCTTTCC
TGGTGTCCCGTCGCGGCTTGGGACCCGGCAAGATGGGCAAGAAGGGCAAGAAGGAGAAGAAGGGCCGCGG
CGCGGAGAAGACGGCCGCCAAGATGGAGAAGAAGGTGTCTAAGCGCTCGCGGAAGGAGGAGGAAGACCTG
GAAGCGCTCATAGCCCATTTCCAGACACTCGATGCCAAGAGGACTCAGACTGTGGAACTTCCGTGCCCCC
CACCCTCACCAAGGTTAAATGCCTCCCTCTCGGTTCATCCTGAGAAAGATGAGTTAATCCTTTTTGGAGG
TGAATATTTCAACGGCCAAAAAACTTTTTTGTATAACGAGCTCTATGTCTACAATACCAGAAAGGACACC
TGGACCAAAGTTGACATCCCCAGTCCACCTCCGAGGCGCTGTGCTCACCAGGCGGTGGTAGTGCCTCAAG
GTGGCGGACAGCTGTGGGTCTTTGGAGGGGAGTTTGCCTCTCCCAACGGAGAGCAGTTCTACCACTACAA
GGATCTCTGGGTCCTGCATTTGGCCACCAAGACCTGGGAACAAGTCAAATCAACAGGCGGTCCTTCGGGT
CGGAGTGGACATCGGATGGTGGCCTGGAAGAGACAATTGATCCTGTTTGGTGGCTTCCATGAAAGTACAC
GGGATTACATCTACTACAACGACGTGTATGCCTTTAATCTGGACACCTTCACATGGAGCAAGCTGTCCCC
GTCAGGGACGGGCCCACACCCAGATCAGGCTGCCAGATGTCCGTCACTCCCCAGGGCGGCATCGTCGTC
TATGGGGGCTACTCGAAACAGAGAGTTAAGAAAGACGTGGACAAGGGCACACGGCACTCAGACATGTTCC
TGCTGAAGCCAGAGGACGGAAGAGAAGACAAGTGGGTTTGGACTCGGATGAACCCTTCGGGGGTCAAGCC
CACCCCACGGTCTGGCTTTTCCGTGGCCATGGCCCCGAATCACCAGACACTGTTCTTCGGGGGTGTCTGT
GACGAGGAAGAGGAGGAGAGCCTGTCGGGCGAGTTCTTCAACGATCTGTACTTCTACGACGCCACCAGGA
ACCGTTGGTTTGAGGGACAGCTGAAGGGACCCAAGTCTGAAAAGAAGAAACGCAGGCGGGCAGAAAAGA
GGAGCCCGAAGGTGGTAGCAGGCCGGCGTGTGGGGGAGCTGGCACCCAGGGGCCTGTGCAGCTGGTCAAG
GAGGTGGTGGCCGAGGATGGCACCGTGGTCACCATTAAGCAGGTGCTCACCGCGCCAGGCTCGGCGGGGC
AGCCCCGGTCTGAGGACGAAGACAGCCTTGAGGAGGCCGGCAGCCCCGCACCTGGGCCGTGTCCACGCTC
CAACGCCATGCTGGCTGTGAAGCATGGGGTGCTCTACGTCTATGGGGGCATGTTTGAGGCCGGCGACCGC
CAGGTCACCCTCAGCGACCTGCACTGCCTGGACCTGCACAGGATGGAGGCGTGGAAGGCTTGGTGGAGA
TGGACCCAGAAACTCAGGAGTGGCTGGAGGAGACGGACTCGGAAGAGGACAGTGAGGAGGTTGAGGGCGC
CGAGGGTGGGTCGACGACGAAGACAGCGGAGAGGAGAGCGGTGCGGAGGACTGAGAAGAGCCCCTGCCA
GGGGCGCCTGGCAAGTGCTGTGCCCACGTCCGCCCAGGACCCAGCCGTGTTGAGTGAAGCTCTTGGGGCC
AGCGTGCGTCCTGACGCACAGGAGAGAGCTGAAGGTGGGTGGCCCAGGCCAGGGTGTGAACTTTCTCCCA
TGGTTTAGTCTCTGACGCGGCACTGGGCCGGAAGTTCAACTGAGTGCAGTGCAGGTGGATTCCCTCAGCA
```

Figure 20 (Continued)

GCCTGTGTGTTGTGTGAAATAAATTGGACTTGAAACAAGAAAAAAAAAAAAAA

>gi|336020381|ref|NM_017612.3| Homo sapiens zinc finger, CCHC domain containing 8
(ZCCHC8), mRNA
GCCCCGTGTGCAGCTTTCGCGGCCTGCGTCTGGAGAAAACCCTAGCGGGTGGCTCCGTGCGGCCAGAGCT
CTAGAGAGTGGTGCCGCCTTCCAACCTTCTTCCCCAAGCCCTGGTGGCCGGCTCCGCCTCTTCTCGAATC
TTTTCCACAGCCCAAAATGGCCGCAGAGGTGTATTTTGGCGATCTAGAGCTCTTCGAGCCGTTCGACCAC
CCAGAGGAGTCGATTCCGAAGCCCGTTCACACTCGCTTCAAGGACGACGACGGCGACGAGGAGGACGAAA
ATGGGGTCGGCGACGCGGAGCTACGGGAGCGGCTTCGGCAGTGCGAGGAGACCATCGAGCAGCTCCGCGC
CGAGAATCAAGAACTTAAACGAAAATTGAACATTCTGACTCGACCGAGTGGAATATTGGTGAACGATACT
AAGTTAGATGGACCTATATTACAGATTCTATTCATGAACAATGCTATTTCAAAGCAATATCATCAAGAAA
TAGAGGAATTTGTATCAAATTTAGTAAAAAGATTTGAGGAACAGCAGAAAAATGATGTGGAAAAGACTTC
CTTTAATCTTTTGCCCCAGCCATCCAGTATTGTGCTAGAGGAGGACCACAAAGTGGAAGAGTCCTGTGCC
ATTAAAAACAACAAGGAAGCTTTCAGTGTTGTAGGAAGTGTCCTGTATTTTACTAATTTTTGCCTTGATA
AATTGGGGCAACCGCTTCTAAATGAAAACCCTCAGCTTTCCGAAGGATGGGAAATACCCAAGTACCATCA
AGTCTTCAGCCACATTGTTTCTCTAGAAGGGCAAGAAATACAAGTAAAGGCAAAAAGGCCAAAGCCTCAC
TGTTTCAATTGTGGTTCTGAAGAACACCAAATGAAAGATTGCCCAATGCCTCGGAATGCTGCTCGAATAA
GTGAAAAGAGAAAAGAGTATATGGATGCCTGTGGAGAAGCAAACAATCAGAATTTCCAGCAGCGATACCA
CGCAGAAGAAGTAGAAGAAAGATTTGGAAGATTCAAGCCAGGAGTTATTAGTGAGGAACTTCAAGATGCA
CTAGGTGTGACAGACAAGAGTCTTCCACCTTTTATCTATCGGATGCGCCAGCTAGGGTACCCACCAGGGT
GGCTCAAAGAGGCTGAATTGGAGAATTCGGGGCTTGCACTCTATGATGGAAAAGATGGCACTGATGGGGA
AACAGAAGTTGGAGAAATACAACAGAATAAAAGTGTCACTTACGATCTCTCAAAATTGGTCAACTATCCT
GGTTTTAATATATCTACTCCCAGAGGAATTCCAGACGAATGGAGGATCTTTGGTTCCATACCAATGCAGG
CATGTCAGCAGAAGGATGTGTTTGCCAATTACCTTACTTCTAACTTCCAAGCGCCAGGTGTGAAGTCTGG
CAACAAGAGGTCTTCATCTCACTCTAGCCCAGGTAGTCCAAAGAAGCAGAAGAATGAAAGCAACTCAGCG
GGATCTCCCGCCGACATGGAGCTCGATTCAGATATGGAGGTACCACATGGTTCTCAGAGCAGCGAAAGTT
TTCAGTTTCAACCACCATTACCTCCTGACACTCCTCCACTCCCCGGGGAACTCCTCCACCCGTCTTCAC
CCCTCCACTCCCAAAGGGCACCCCGCCGCTGACTCCCAGTGACTCACCCCAGACCAGAACAGCATCTGGA
GCTGTGGATGAGGACGCACTGACTCTAGAAGAACTTGAAGAACAGCAGAGGCGGATCTGGGCAGCTCTTG
AGCAGGCCGAGAGCGTAAACAGCGACTCCGACGTTCCTGTGGACACACCTTTAACTGGCAATTCCGTTGC
CTCATCACCTTGTCCAAATGAGCTAGACCTCCCTGTCCGGAGGGAAAAACATCTGAAAAGCAGACGCTG
GATGAGCCTGAGGTACCAGAGATTTTTACAAAGAAATCAGAAGCTGGACATGCCTCCAGTCCAGACTCTG
AGGTGACATCACTTTGTCAGAAGGAAAAAGCAGAGTTGGCTCCGGTAAACACTGAAGGTGCCCTTCTTGA
TAATGGCAGTGTCGTACCAAACTGTGACATCAGCAATGGGGGCAGCCAGAAGCTCTTTCCTGCAGACACC
AGTCCTTCAACGGCCACTAAAATTCATAGCCCTATACCTGACATGAGCAAATTTGCAACTGGAATCACGC
CATTTGAATTTGAGAATATGGCAGAATCTACTGGAATGTACCTCAGGATAAGAAGCTTGTTAAAGAACTC
ACCCCGAAACCAGCAGAAAAACAAAAAGGCCTCTGAATAATGGCTTGACTTAGCACTGAGAGCTATTTAA
TAACTTTGTTCCGTTAATTAGTACTAATTAAGTGGATAGATAGAATGGTTTTCCTGTTTGTCCCTCCCAT
GTTTAAAAATCTATCCAAGGTTCATGTTCCAAAGTCAAGCCTATTTTAAAGAAAGACTGAGCTCACTAGT
TCAGTATATTTTATTCTCACTGACAAAACTTGGGGGGAGATGTGAATATGACCTGGTTTAGAGAGGGTTT
GTTAAGGTTTATACTATTTTTGGATTGTGACTATCCGTCGAGAGTGATGGTTTTTATCTGTCTTTTGTAC
ATTGTTTTCCCTTTCTACATTTTGCTAATTATCCTGTATATAAGTTTAATATATCACTTTTTAAAAGAAA

Figure 20 (Continued)

```
AAATTCTACCATTTTAAATTCATGTTTCAACTCCTACAACCAAATGAGAAAAATCAGGGATGAGCAGCTT
TATCCCATTTGGGGTATTTTTGTAAGTGATTTACATGTGTCAATTTTAGTAATACTTTTACTTTTTTGTA
ACTTCATCCTTCATATATGCTTGCTATACAGGTATGTTCATCTTTGTGTACAGAGGTTTAATAAATTAGT
TTTCATATACATAATCTAAGACTTTGAATACAAAAAAGTGATTCACAGGTAAAATCAGTGTATATAACCT
TTTTTTTTTTGAGACAAGGGTTTCACTCTTGTTGCCCAGGCTGGAGTGCAATGGCACAATCTCGGCTCA
CCGCAACCTCCGCCTCCCGAGTTTAAGCGATTCTCCTGCCTCAGCCTCCGGAGTAGCTGGGATTACAGGC
ATGTGCCACCACGCCCAGCTAACTTCGTATTTTTAGTAGAGATGGGGTTTCTCCACGTCGGGTCAGGCTG
GTCTTGACCTCCTGACTTCAGGTGATCTGCCCGCCCAGCCTCCCAAAGTGCTGGGATTACAGGCGTAAGC
CACCTCACCTGGCCGGTGCATATAACTTTTAAGTTTAAAAGTAAATTGTTGGCCAGGCGTGGTGGCTCAT
GCTTATAATCCTAGCACTTTGGGAGGCCAAGGAGGAAGGATCACCTGAGGTCAGGAGTTCGAGACCAGCC
TGGCCAACATGGCAAAACCCCATCTCTACATAAATACAAAAATTAGCCAGGTGTGGTGGTACATGCCTGT
AATCCCAGCTACTCGGGAGGCTGAGGCAGGAGAATCACTTGAACCTGGGAGTGGGAGGTTGCAGTGAGCC
GAGGTCGCGCCATTGCACTCCAGCCTGGGCAACAAGAGCAAAACTCCATCTCAAAAAAAAAAAAAAAAAA
AGGTAAATTGTAAAAATCAGTGGTAGCAAAACAAAAATAATGATAGGAATTGCAAGTTTGGGTGTTTTCA
GTGGATTTCAGCCTTAAATATAGAAACAGCAGAATTTTTGAAAAGTAATTATTTTGAAAAATGAATGGCA
TGCAGCTAGCCTTTGTATAAAAATAATTTTCTAGATTTGAACCCTAATAGTTAAAAATTAAAAATTAAAC
ATAAACATACTGCTTTTAATTGTCAGGTATATATATAAGATAGAGCTGAAACTGTGGTTTAGGTCTTTCT
GTGGAATGCCATTACATCTTTATATTAGTCAAGTCCATGAAAATAAATGTTTAGATCGTCTTGAATTGTT
AGTCTCAGGCAGTGTTATCCTGCTCTCAGGCCAACAGGGGGAGCAAAATAGAAACATTCCAGATATAGCT
TTCATTTTTGAGAACTTGAGTAATCAGAATTTACTGTTCTGTAAAGAATAAAGGAAAGGAAAATTATAAA
GAGAGAAATTTCTTTTTAAAGCCCTCACAGAATGTGCTAGAAATAGAATAAAATTTAAAATACTTTTGGC
TTCTTTTCCTCAGCTTAAGTTCAAAATAAAAGCAATCCTTTACAGTTGAAAAA

>gi|41350197|ref|NM_017704.2| Homo sapiens ankyrin repeat domain 49 (ANKRD49),
mRNA
AGACGAACCCGGAAGTGAGATGCAAGGCGGCGATTTTCCCTTCTGTCAGATCTTGATGAACAAAGCAGTC
ATAATTCATCTCTAGAAAGATTTATATCCTGGCATTTGAAATGCTTTTTATTTAGAATAGTAGTAAAAAA
TGGAAAAAGAAAAAGGAAATGATGATGGAATACCAGACCAAGAGAATTCCTTGGATTTTTCTGAACACTT
TAACCAACTTGAATTGTTGGAAACACATGGACACCTTATTCCTACTGGTACTCAAAGTCTTTGGGTAGGC
AATTCTGATGAAGATGAGGAGCAAGATGACAAAAATGAAGAGTGGTATCGATTGCAAGAAAAAAAATGG
AAAAAGACCCAAGCAGATTGCTTCTTTGGGCTGCTGAAAAAAATCGGCTTACCACAGTGCGGAGACTCCT
TTCTGAAAAGGCCACTCACGTGAACACTAGGGATGAAGATGAGTATACCCCTCTTCATCGAGCAGCCTAC
AGTGGACACTTAGATATTGTTCAGGAGCTCATTGCACAGGGGCCGATGTTCATGCAGTGACTGTGGATG
GCTGGACGCCCCTGCACAGTGCTTGTAAGTGGAATAATACCAGAGTGGCTTCTTTCTTACTGCAGCATGA
TGCAGATATCAATGCCCAAACAAAGGCCTCTTGACCCCCTTGCATCTTGCTGCTGGGAACAGAGACAGC
AAGGATACCCTAGAACTCCTCCTGATGAACCGTTACGTCAAACCAGGGCTGAAAAACAACTTGGAAGAAA
CTGCATTTGATATTGCCAGGAGGACAAGTATCTATCACTACCTCTTTGAAATTGTGGAAGGCTGTACAAA
TTCTTCACCTCAGTCTTAACAATTCTAGTAATTTTCCTAAGTTTCTAAATACCAGTGCCTCCTGTGTGTG
AGATGTATTCCCATAATCAAAGTTGACGTCAAACATCTTACTACAAAAATTCAGTGACATTCATTATAAC
ATTCTTCCAAGTGAATTGCCTGACTTTGATGTCAAAATGTATTTGAAAGTAATTTGCATATATCTTTAAT
TATTTCTGTGGAGTTTGTGATTTTTTTATCAGAAATAATTTTAATGTGTGTATACTTAAAAACTTGACAC
GGGTTGTACAGAAACTGGTATTTTTGGTGCTGATACAAGAGAAATGTATTTTTAAATATCCCACATCCTG
```

Figure 20 (Continued)

GATCTTTGTTGGGTATTTAGTATATTGACATATATTTTTATAAGGTGAGGTAACTCAGAACTTAATTTAA
AAGTCTTAAATATTCTGATACAATTCAGCTGTCTTCTCTACCTTACCATAGCCAGTTGCTTTCATTTTAA
ACCAGAGCAAGTAACATATTAGTGACTTGAATCTTCATAAGTTAAAGTAAAAAACAGCAAAAAACCTAGA
TCTTTGTCTTTTAGAACACAGACCATTTTCAGGAAAGCAGTTAGCTAAGTGTTTAATTCATGAATATTGT
ATACTGCATCCCCTACCACAATTTACACAATCCTGTGGATAGTCCTACCTCACCCTGGTCAACCTACATG
ATCCTTAAGCTAATGGCGAATCACGATGACCTTGTAGACATGCACACAACTATACCTTTGTCCAACAGAT
CATAATATATCTGCTATCCAACTGGTTTTACCTGCCTAATCCTACTGATTTGGGCACTGCTTGTATAGTC
TCTCAAGTTCACAGGAAATGTTGATTTTCTAAGGTCCTCATTTTTACAGAGTATACAGGCAAAGTGACAG
GGGAAAAGGAATTAGTCTAAGAGTAAGGGGATGATTATTATATTGAGGCTAAAACCACAAAGTGGCTCAG
GCTTTAAAAAAAAAACACTGTGGATAATGACAAAAAGCATAAGTAAAAATATTTGAGAAAAATAAAGTAC
AAGTTTTGAACAACAAAAAAAAAAAAAAAAAAAAA

>gi|269914123|ref|NM_017830.3| Homo sapiens OCIA domain containing 1 (OCIAD1),
transcript variant 1, mRNA
ATTTCCTGCCGTAAGTATACAGTGCCTCCGGGTCGCGGTCATTTTGAGCCCCTGTCTGGATGACTTCTTG
CGGCTGTTCTACCCCTCCCCCTCCCCGCGGTACCTTGCACTTTTCTCCCTCCCTGCCCCCTCTCGAGTCC
ACCCTCCGGGCCTTCTGCCCCTGATCGCTTGGTTTTCCTTGCAGTCGCCTGCTGCTGTCGTCGGGAGGAA
AGATGAATGGGAGGGCTGATTTTCGAGAGCCGAATGCAGAGGTTCCAAGACCAATTCCCCACATAGGGCC
TGATTACATTCCAACAGAGGAAGAAAGGAGAGTCTTCGCAGAATGCAATGATGAAAGCTTCTGGTTCAGA
TCTGTGCCTTTGGCTGCAACAAGTATGTTGATTACTCAAGGATTAATTAGTAAAGGAATACTTTCAAGTC
ATCCCAAATATGGTTCCATCCCTAAACTTATACTTGCTTGTATCATGGGATACTTTGCTGGAAAACTTTC
TTATGTGAAAACTTGCCAAGAGAAATTCAAGAAACTTGAAAATTCCCCCCTTGGAGAAGCTTTACGATCA
GGACAAGCACGACGATCTTCACCACCTGGGCACTATTATCAAAAGTCAAAATATGACTCAAGTGTGAGTG
GTCAATCATCTTTTGTGACATCCCCAGCAGCAGACAACATAGAAATGCTTCCTCATTATGAGCCAATTCC
ATTCAGTTCTTCTATGAATGAATCTGCTCCCACTGGTATTACTGATCATATTGTCCAAGGACCTGATCCC
AACCTTGAAGAAAGTCCTAAAAGAAAAAATATTACATATGAGGAATTAAGGAATAAGAACAGAGAGTCAT
ATGAAGTATCTTTAACACAAAAGACTGACCCCTCAGTCAGGCCTATGCATGAAAGAGTGCCAAAAAAAGA
AGTCAAAGTAAACAAGTATGGAGATACTTGGGATGAGTGAAAAATTACATCATTGGACATGAAGGAGTTT
CAACATCCAGCTTCATCTAGGTGGTCATGATTACCTGCATGCTTTGAGCTCAGCAGCAGTCTTCATAAAC
ACATTTAAAACAAGATCCTGGGTTTTTGTGGTTTGACTTCTATGGTGTTTTAAAAAAACACAGATTTTTA
GTGTTAATATTGTGTAAATGTACTCACCTTAGGGATTCATTTGAATGATGGTATTATACCATGATTGTAT
ACAGTTTGTGAAATTGTTGCAAGGGCAAAGATAACTCTTAAAAAACCGTCGAGATTACAATGCTCTAGAA
TCAGCATATAAGAAAATAAATGATATCTGCATGTTGAATTGGGGTGGATGGGGGAGCAAGCATAATTTT
TAAGTGTGAAGCTTTGCATCAAGAAATTATTAAAAAGCTTTTTTTCTCCAGTATTTTCTGTATTATCTTA
ATGTTTATGGCAAATAAAATGTAAAGGAACATGCAACAGCCCTCATCTTCCTTGATTTTATGGTTTTATT
GTTTGTAATTTATTGATTTATTTTTAAGCTAGTTATAATCATGTAGGTATAGGAAATAAAGTCATCTATA
ATATTTCTATAATATGGCTATAATATGGCTATAAATCTATAATATGGCTGGAGGCAGTGGGCAGTGGTTC
ATGCCTGTAATCCCAGCACTTTGGGAGGCCGAAGTGGGAGGATTGCATGAGTCCAGGAGTTTGAGACCAG
CCTGGGCAACAAAGCGAGACCCTGTCTTTACAAAAAAATAAAAATTAGCTGGCGATGGTGTCGTGTGCCT
GTAGTCCTAGTTACTTAAGAGGCTGAGTTGGGAGGATCAGTTGAACCCAGTGGTTCTGGGTTGCAGTGAG
CTGTGGTCACACCACTGAACTCCAGCCTGTGCGACTGAGTGAGACCCTGTGTCTAAAAAAATAAAAATAT
AATGAATGTGATTTATGTAGATAAATTGATAATATAGTAAATAGGTAAATGCCTTAAAAAGCATTTTTAA

Figure 20 (Continued)

AGAATTTGTAAATTCTAAAACAATAAAAATTTGGTATACATCACA

>gi|51593093|ref|NM_017946.2| Homo sapiens FK506 binding protein 14, 22 kDa (FKBP14), mRNA
TAAATGTGCCACGTCTTCTAAGAAGGGGGAGTCCTGAACTTGTCTGAAGCCCTTGTCCGTAAGCCTTGAA
CTACGTTCTTAAATCTATGAAGTCGAGGGACCTTTCGCTGCTTTTGTAGGGACTTCTTTCCTTGCTTCAG
CAACATGAGGCTTTTCTTGTGGAACGCGGTCTTGACTCTGTTCGTCACTTCTTTGATTGGGGCTTTGATC
CCTGAACCAGAAGTGAAAATTGAAGTTCTCCAGAAGCCATTCATCTGCCATCGCAAGACCAAAGGAGGGG
ATTTGATGTTGGTCCACTATGAAGGCTACTTAGAAAAGGACGGCTCCTTATTTCACTCCACTCACAAACA
TAACAATGGTCAGCCCATTTGGTTTACCCTGGGCATCCTGGAGGCTCTCAAAGGTTGGGACCAGGGCTTG
AAAGGAATGTGTGTAGGAGAGAAGAGAAAGCTCATCATTCCTCCTGCTCTGGGCTATGGAAAAGAAGGAA
AAGGTAAAATTCCCCCAGAAAGTACACTGATATTTAATATTGATCTCCTGGAGATTCGAAATGGACCAAG
ATCCCATGAATCATTCCAAGAAATGGATCTTAATGATGACTGGAAACTCTCTAAAGATGAGGTTAAAGCA
TATTTAAAGAAGGAGTTTGAAAAACATGGTGCGGTGGTGAATGAAAGTCATCATGATGCTTTGGTGGAGG
ATATTTTTGATAAAGAAGATGAAGACAAAGATGGGTTTATATCTGCCAGAGAATTTACATATAAACACGA
TGAGTTATAGAGATACATCTACCCTTTTAATATAGCACTCATCTTTCAAGAGAGGGCAGTCATCTTTAAA
GAACATTTTATTTTTATACAATGTTCTTTCTTGCTTTGTTTTTTATTTTTATATATTTTTTCTGACTCCT
ATTTAAAGAACCCCTTAGGTTTCTAAGTACCCATTTCTTTCTGATAAGTTATTGGGAAGAAAAAGCTAAT
TGGTCTTTGAATAGAAGACTTCTGGACAATTTTTCACTTTCACAGATATGAAGCTTTGTTTTACTTTCTC
ACTTATAAATTTAAAATGTTGCAACTGGGAATATACCACGACATGAGACCAGGTTATAGCACAAATTAGC
ACCCTATATTTCTGCTTCCCTCTATTTTCTCCAAGTTAGAGGTCAACATTTGAAAAGCCTTTTGCAATAG
CCCAAGGCTTGCTATTTTCATGTTATAATGAAATAGTTTATGTGTAACTGGCTCTGAGTCTCTGCTTGAG
GACCAGAGGAAAATGGTTGTTGGACCTGACTTGTTAATGGCTACTGCTTTACTAAGGAGATGTGCAATGC
TGAAGTTAGAAACAAGGTTAATAGCCAGGCATGGTGGCTCATGCCTGTAATCCCAGCACTTTGGGAGGCT
GAGGCGGGCGGATCACCTGAGGTTGGGAGTTCGAGACCAGCCTGACCAACACGGAGAAACCCTATCTCTA
CTAAAAATACAAAAGTAGCCGGGCGTGGTGATGCGTGCCTGTAATCCCAGCTACCCAGGAAGGCTGAGGC
GGCAGAATCACTTGAACCCGGAGGCGGAGGTTGCGGTAAGCCGAGATCACCTCCAGCCTGGACACTCTGT
CTCGAAAAAAGAAAAGAAACACGGTTAATAACATATAAATATGTATGCATTGAGACATGCTACCTAGGA
CTTAAGCTGATGAAGCTTGGCTCCTAGTGATTGGTGGCCTATTATGATAAATAGGACAAATCATTTATGT
GTGAGTTTCTTTGTAATAAAATGTATCAATATGTTATAGATGAGGTAGAAAGTTATATTTATATTCAATA
TTTACTTCTTAAGGCTAGCGGAATATCCTTCCTGGTTCTTTAATGGGTAGTCTATAGTATATTATACTAC
AATAACATTGTATCATAAGATAAAGTAGTAAACCAGTCTACATTTTCCCATTTCTGTCTCATCAAAAACT
GAAGTTAGCTGGGTGTGGTGGCTCATGCCTGTAATCCCAGCACTTTGGGGGCCAAGGAGGGTGGATCACT
TGAGATCAGGAGTTCAAGACCAGCCTGGCCAACATGGTGAAACTTGTCTCTACTAAAAATACAAAAATT
AGCCAGGCGTGGTGGTGCACACCTGTAGTCCCAGCTACTCGGGAGGCTGAGACAGGAGATTTGCTTGAAC
CCGGGAGGCGGAGGTTGCAGTGAGCCAAGATTGTGCCACTGCACTCCAGCCTGGGTGACAGAGCAAGACT
CCATCTC >gi|58218978|ref|NM_018070.3| Homo sapiens single stranded DNA binding protein 3 (SSBP3), transcript variant 2, mRNA
AGCGGAGAGCGGGCGGCCGTGCGGGCGGCGGCGGCGGCACCCCAGGCCGAGCCGGCGCGGAAGGAGTTC
CAGGGCGATGGGGCCGCGGCCGGGGCTGACGCTTTGACAGCTGGAAAGAGCGCGGAGCCAGCGCCTGGGG

Figure 20 (Continued)

```
GGGAGGGAGGGGAGCGCGGCGAGGAGAGCGCCAGCGAGCGAGAGAGCGAGCGAGCGCCGGGGAGGGGCC
GGGAGCGAGGGGCAGCTCGGGAGAGCCGGAGCGGTAGCGGCGGCGGCGGCGGCGGCGAGGCTCGGCG
CCCTCTTCCCTGCAAACCATGTTTGCCAAAGGCAAAGGCTCGGCGGTGCCCTCGGATGGGCAGGCTCGGG
AAAAGTTAGCTTTATACGTCTACGAATATTTACTGCACGTAGGAGCACAGAAATCTGCACAGACCTTCTT
ATCGGAGATTCGATGGGAAAAAAACATCACGTTGGGAGAACCGCCTGGGTTTTTGCACTCGTGGTGGTGT
GTATTTTGGGACCTTTACTGTGCAGCTCCTGAAAGGAGAGACACTTGTGAACATTCAAGTGAAGCAAAAG
CCTTTCATGATTATAGTGCAGCAGCTGCCCCGAGCCCCGTGCTTGGCAACATTCCCCCAACGATGGGAT
GCCGGGAGGCCCCATCCCGCCAGGTTTCTTTCAGGGTCCTCCGGGGTCACAGCCCTCGCCGCACGCACAG
CCTCCACCTCACAATCCTAGCAGCATGATGGGACCCCACAGTCAGCCTCCGGGAGGAGTTCCTGGGACAC
AGCCATTGCTGCCCAATTCTATGGATCCCACACGACAACAAGGCCACCCCAACATGGGAGGATCAATGCA
GAGAATGAACCCTCCCCGAGGCATGGGGCCCATGGGTCCCGGCCCACAGAATTACGGCAGCGGCATGAGA
CCACCACCCAACTCCCTCGGCCCCGCCATGCCCGGGATTAACATGGGCCCGGGAGCTGGCAGACCCTGGC
CCAATCCTAACAGTGCTAACTCAATTCCATACTCCTCCTCATCACCTGGTACCTATGTGGGACCCCCTGG
TGGTGGCGGTCCTCCAGGAACACCCATTATGCCCAGTCCCGCAGATTCAACAAATTCCAGTGACAACATC
TACACAATGATTAATCCAGTGCCGCCTGGAGGCAGCCGGTCCAACTTCCCGATGGGTCCCGGCTCGGACG
GTCCGATGGGCGGCATGGGTGGCATGGAGCCACACCACATGAATGGATCATTAGGGTCAGGCGACATAGA
CGGACTTCCAAAAAATTCTCCTAACAACATAAGTGGCATTAGCAATCCTCCAGGCACCCCTCGAGATGAC
GGCGAGCTAGGAGGGAACTTCCTCCACTCCTTTCAGAACGACAATTATTCTCCAAGCATGACGATGAGTG
TGTGATCCCCCCTTCTCCGAGACGCTGAGAGAGCAGGCATTGCAGGCGGGAAGATGCCAGAAATTATGCA
AGAAGTGAGGTGTCATTATCCAGGAGCTGGTGGGAGGGCATCTCCCTGCTCCCCTCAACCCCCTCCCAC
CCCATCCACGCCCCTACCTTTCCCAATTTTAGTTTCATGCAATAAAAAGGCCAAACTTTTTATTCCATA
AAACAAGAAGGACAAAACTCTCAAAAATGTATTTCAAGTCAGTGACCAGAAAAATCCCACCCCTTGCCCT
TTCCCCAAAGGACCTTTTCTGTACATGACACTTTTTTGTTGTTTTTGTTTGGGTTTTACCATTGTTGG
GATTTTTTTATTTGTTTTCAGGGGGGTTTTTTGGGGAAAATTTTTTTAAATGGAAGCTTCTAGCAAGCC
CCCCACCCCAATCAACCTCTATGCTTTCTTCTTAAAAAAAAAAAAAAAGGAAAAAGGAAAAAAAAAAAG
GAAAACCAGAAGCCCTGCTGTCTGTCTGTGCCCAAGCCCTTCCACCAGAAAAGCTAGTCTAGGTGTGAGA
GCCCACATTGTCTGTAGCCATCAAAAATAATAATAATAAACTGGACAGTTTACA

>gi|38605734|ref|NM_018243.2| Homo sapiens septin 11 (SEPT11), mRNA
GGCGTGGGGGGAGCAGATGCCGCTGGCTGCCAGCGGGACGCCGGCGAGCAGAGCGCAGCCGCGAGGGAGG
CGCGAGGGAGGCGAGCCGGAGCCCGAGCACTAGCAGCAGCCGGAGTCGGCGTAAAGCACCCGGGCGCAGC
CGGAGCCGGTGCCGCAGCTGCGATGGCCGTGGCCGTGGGGAGACCGTCTAATGAAGAGCTTCGAAACTTG
TCTTTGTCTGGCCATGTGGGATTTGACAGCCTCCCTGACCAGCTGGTCAACAAGTCTACTTCTCAAGGAT
TCTGTTTCAACATCCTTTGTGTTGGTGAGACAGGCATTGGCAAATCCACGTTAATGGACACTTTGTTCAA
CACCAAATTTGAAAGTGACCCAGCTACTCACAATGAACCAGGTGTTCGGTTAAAAGCCAGAAGTTATGAG
CTTCAGGAAAGCAATGTACGGCTGAAGTTAACCATTGTTGACACCGTGGGATTTGGAGACCAGATAAATA
AAGATGACAGCTATAAGCCGATAGTAGAATATATTGATGCCCAGTTCGAGGCCTACCTGCAAGAGGAATT
GAAGATTAAACGTTCTCTCTTCAACTACCATGACACGAGGATCCATGCCTGCCTCTACTTTATTGCCCCT
ACTGGACATTCACTAAAGTCCCTGGATCTGGTCACCATGAAAAAGCTGGACAGTAAGGTGAACATCATTC
CAATAATTGCAAAAGCTGACACCATTGCCAAGAATGAACTGCACAAATTCAAGAGTAAGATCATGAGTGA
ACTGGTCAGCAATGGGGTCCAGATATATCAGTTTCCCACTGATGAAGAAACGGTGGCAGAGATTAACGCA
ACAATGAGTGTCCATCTCCCATTTGCAGTGGTTGGCAGCACCGAAGAGGTGAAGATTGGCAACAAGATGG
```

Figure 20 (Continued)

```
CAAAGGCCAGGCAGTACCCCTGGGGTGTGGTGCAGGTTGAGAATGAAAATCATTGCGATTTTGTGAAACT
TCGAGAGATGCTGATCCGCGTGAACATGGAGGACTTGCGAGAGCAGACTCACACCCGCCACTATGAATTG
TACCGACGCTGTAAGCTTGAAGAGATGGGGTTCAAGGACACTGACCCTGACAGCAAACCCTTCAGTCTTC
AGGAGACATATGAAGCAAAAAGGAATGAATTCCTGGGAGAACTGCAGAAGAAAGAAGAAGAAATGAGACA
AATGTTTGTTATGAGAGTGAAGGAGAAAGAAGCTGAACTTAAGGAGGCAGAGAAAGAGCTTCACGAGAAG
TTTGACCTTCTAAAGCGGACACACCAAGAAGAAAAGAAGAAAGTGGAAGACAAGAAGAAGGAGCTTGAGG
AGGAGGTGAACAACTTCCAGAAGAAGAAAGCAGCGGCTCAGTTACTACAGTCCCAGGCCCAGCAATCTGG
GGCCCAGCAAACCAAGAAAGACAAGGATAAGAAAAATGCAAGCTTCACATAAAGCCTGGCAAGCCAAGGA
TGTTCCCGCATTCACCTGCTTTTGCAGTAATATCGTATCTCTGCCATGTGTGTTCTTTAGTTTTATTTTA
TTTTATTTTATTTTTTTACCCTTCCTCAAACACCAGTAACTATTATTAACTCGTTTTGCTGAATGTTGTT
GGGTGGTAGAAAATGATAGAACAAGGGAATAACCGCGAATGCTCTGTGCAGCTGGACTCTGTTTCCGGAA
AGTAAATGATTTGCTTTTTATGCCTGTTCTGAATGGCAGCACGAAGCAGGCCTGTTACTTGTATGTCGCT
TTGGACAGAGGAAAGTGGGGTAAAATGCTACCTGTACGTCTGACATGAAAACTTCTCACCGCCTCAGCAG
CTGAACTAAAAACCTGAATAGCCATGACAAGAGTTTGCATTTTCTTGATGATTCATCTCCATGAGTGCAC
AATCCCTGAACTCACTGTCTTTTCTCCACACTTGTCCTAAGCCAAGGTAGATTTGTACGTAGACAGACTG
GTGAGCAAGCATTATATTTTATTTTTACCCTTGCATGACATTTTCATTTTAATCAATAACATTATTTGGC
CTGAGCTTGTGGGTCTGTTCAGACTGTCTCCTCTCATGGTTTGAAACTGCATCTGAATGCCTGCCTTCAA
TCCTGGCCAAGTTGGAGTAGACTGGTATGAGAAAACTATGATTAGTTCACATTTACTGGTGCATCCTTGA
TCCTCTCACAGATAGAGGTCTTAAAGGTTGGATCATGTAACATTGCTTAGTAGAAGAATCTTCTTCTAAG
GATGATGGGCTTTCTACAGCCTGCTTACCACTAACAGTAAGGAATCTTTCATAAACACACCTCAGTTTGT
TCCCAGTGGGCTTAGAGGGAGGACCTGATGACTGATTCCAGGATACTTGTACTTCTAATAACATTTTTCA
TGAATCATGAGAAAATTTCCACAGATACTTCCCTTAGAAAATTTGCTATAAACTCTGTATCATTGGTAGC
ACAAATTTGAGCGAGGCCTTGTCAATTTTAAGGTGGAAATAGGAAGGACCACAACATGACCCGTAAGTCA
AGAAGGTAGACATTTCATATCCAGCTTCCTTGCTTAGTCTCCTTTCAGTATTTGGCAATAAAAGAAAGAA
GAAATAGAACAGCTGAAGTCTCAAATCATTGTCTGGAATTTTCCTCACCTTGGCTAGCTCCACCTGCTCT
TTGTCTAAGGCCCTTGCCTCATCAGGGATTAGAACTGGCCCATATGCCAGAACCTGTACTAAATGCCTAA
TTTGTATGGAAGAGTGCATATTTAATCTCTTTTCTATACTGCTCCTTTCTGATGCTTATCCTTTCATCTG
TGTGATTGTTTTTTCCCCTCTACTAACAAGATCCTCCCAGCTTTCTCTCTACATGTAGAAAGGATAACAT
TTCTCATGAACCCACTGCCCCTCTGCATTTTCCTCACTGGTTAGAGATTAAGTAAATAGGATAGAATATG
CTGCGTCTCCCCTGACACACACTTTCTTTTTTGAATGAGCAAGTCTCCATTTTGATTTCAGCAAAGATTT
TTTCTCCTTTTCTTTGTCCTCAACCATACTTAGAGGAAAGAAGGAATGGTCTTCCATGAACTGATTATGC
TTAATTAAGCAAAGTAAGGAAATTAGTTTCATGGAAGCCTAAACAAAGCTGGAATAGAAACTACACACTA
GACACAGCAGTAGTCATAGTCTTCACAGGTTTAGGAGCTACTGGACCAACATTCTTGTTTTTGCTTTTGT
TTTTTTAAATAATTCTAGTCTGGAGCTAACTGTGGAGCAGCCAAATAGTAGCTGGCATGTTGATTCAAAC
CATGGGCTGAATTTGCTCATAGGCTGTGCATCAGACAAAAGCTTGAATATTTGTGTTGTATGCTTGTTCC
AACCACCGCTTGTGTGAGCATTTTTGTGGCTTGTACAGAAAGTACACTTTTAAATTGTCTCTTGCATCAC
TAAAATTTTTTTAAAATGAGCATAACAACGAAAGGCATCCAGCTGACTTTTTGATTCCAAGATTATTGAT
TGGATTGACTTTTTTGCATTAAATTTTTCCCAGCAAAATAAATCATATGGCGAGTCAGGGAATAAAAAGT
CAAAAGAAACAAATAGAAGCTTTTTTTTTAAAAAATGTATTGCTTCTGAACTTTTTCTGCCACTGCTC
CCTAGCCCTGTTTAGTTTGTTATTGCTGCTTTTCTTTTTCTTTCTGTATCTATGCCTTTTTTTCACAGT
AGTCCTTGGCTCTGCACGGAATAAATGATACCCTCAAATCTAATTGGATGTGCTTTCGCCTTTGCATGTA
AGTACGGTAGTAAGAAACCTTTGAGATCTTTCTGACTTTTCAAAATTAGAGAAAGCAAATGGGATGGATA
```

Figure 20 (Continued)

```
GATTTTTTTTTCTTTTCAAGGGGGGCAGGAAGGTAATGGTTTGAGTAGCCTTTGTTTAAAAAAAAGACT
AAATATATTTAAAAGGCCACATTTATATTTTTTTCACAAGAACCACATAATAAATTCCACTTCTTGACCT
GAATTTGGAAATCCGAAATTACTAATCCAGGCCAGGTGTGGTGGCTCATGCCTGTAATCCCAGCACTTTG
AGAGGCCGAGGTGGGCAGATCACTTGAGGCCTGGAGTTCAAGACCACCTTGGCGAACACGGTGAAACCCC
GTCTCTACAAAAAATACAAAAATTAGCCAGGCGTGGTGGCACGTGCCTGTAGTCCCAGCTACTTGGGAGG
CTAAGTCAGGAGAATTGCTTGAACTTGGGAGATGGAGGTTGCAGTGAGCCAAGATTGCACCACTGCATTC
CAACCTGGGTGATGAAGTGAGACTCTCCAAAAAAAAAAAAGAAATTATTAATCCCTGCCTGTGCTCTACA
TAGCCTCATGGGCATCATTGGATAGCTCAGAGGGCCCTTGATTCTGGCAAGGCAAATAAAGCCAGAATGA
GAAATTACCATCTTCTACTAGAGAAAACCAAGAGAAAAATTTTTATGCTAGGATGCCTTTATGACCACTT
AATTTTTTAATCTTAGTTTAATGGTCTCTCCCTGGTGCTAACTGCTGACAGTGGCCACCTCTTTTTTGGG
GATTGAGGGGCCTACATAACTAGCTGGCCTTACCCCATATCTTTTGTTCAAACATAATACCATCTTTTTG
CTTCTTCTGAACTTTAGATCTCCATAACACATGTACTGTAGAATGTGATGGAAAAGCATTGATGAGAATT
TATTGGCAGTTCAGATTGTGTTTTCCCAACTTAGGCTCTTTATTAATTGGTTAAGGTTTTCTCCAAAAAG
GGCATTTCAACAATGGGAATTATTTAATGTAACAGTGGGCACAGATTACTTATCTTCCTTCTCTGCTTTG
TGACTCACCAGCAGTAACACACACAATCCACATCTTGTGCACCTCAAATGAACAGACTTGGTTTCCTTGC
TTTCTTGACATTTCCATGACTGTTTCACATACAAACTATTGGGTGAGGTTTTTCAGCTGTTACCGACCCA
CGTCCTGCTGTCTCTGTGTGGTCCTACAAAAACTGTCCATTCCCACCCCTTTGCTTTGCCATTTGCAAGA
GTCTGGAATTGTCAGGTCTCAGCTTCGAAAAGTCCTGGTTCCACTGACAGGACACATTCTTTAGTGGGAA
TTAAGACCTACAAAGTCTAGTTTGTATGTAGGTATGAAGGGAATTTTTTAAATAAATTGAAAAGCTGTGA
ACAGCATTAGAACTTTGTCTATTTCTTAATTTTAAAATATGCTGATATGCCTTAAACTGTAGTTGTAGAT
CCTTGTCATTTTGCTGTTTGAAAATAACCAATGTGTTTTCTAAAACTGTCGTGTAATCTACTTTCATTGT
TAATGCAGAATTGTCATATATGTAAGCTGCATGTTAGACATTTGTCTTTTTAAACTAAAGTAATTGTAT
TGATGTGAAGCATATCATTTTTTCAAATATGAAAGTGATCACTTAGCAACATGCTTGGTAATTTGGCATC
TGTTAAGGTAGGAGAGTGGTGAACAGATAATCTATGCATATATCACTAGTGCCAAGACATAAAGCGGGGG
AAAATATATTTTTACCCAAACATTAAAAAAAAAAAAAAAAAAAAAAAAAAAA

>gi|365906242|ref|NM_018325.3| Homo sapiens chromosome 9 open reading frame 72
(C9orf72), transcript variant 2, mRNA
GGGCGGGGCTGCGGTTGCGGTGCCTGCGCCCGCGGCGGCGGAGGCGCAGGCGGTGGCGAGTGGATATCTC
CGGAGCATTTGGATAATGTGACAGTTGGAATGCAGTGATGTCGACTCTTTGCCCACCGCCATCTCCAGCT
GTTGCCAAGACAGAGATTGCTTTAAGTGGCAAATCACCTTTATTAGCAGCTACTTTTGCTTACTGGGACA
ATATTCTTGGTCCTAGAGTAAGGCACATTTGGGCTCCAAAGACAGAACAGGTACTTCTCAGTGATGGAGA
AATAACTTTTCTTGCCAACCACACTCTAAATGGAGAAATCCTTCGAAATGCAGAGAGTGGTGCTATAGAT
GTAAAGTTTTTTGTCTTGTCTGAAAAGGGAGTGATTATTGTTTCATTAATCTTTGATGGAAACTGGAATG
GGGATCGCAGCACATATGGACTATCAATTATACTTCCACAGACAGAACTTAGTTTCTACCTCCCACTTCA
TAGAGTGTGTGTTGATAGATTAACACATATAATCCGGAAAGGAAGAATATGGATGCATAAGGAAAGACAA
GAAAATGTCCAGAAGATTATCTTAGAAGGCACAGAGAGAATGGAAGATCAGGGTCAGAGTATTATTCCAA
TGCTTACTGGAGAAGTGATTCCTGTAATGGAACTGCTTTCATCTATGAAATCACACAGTGTTCCTGAAGA
AATAGATATAGCTGATACAGTACTCAATGATGATGATATTGGTGACAGCTGTCATGAAGGCTTTCTTCTC
AATGCCATCAGCTCACACTTGCAAACCTGTGGCTGTTCCGTTGTAGTAGGTAGCAGTGCAGAGAAAGTAA
ATAAGATAGTCAGAACATTATGCCTTTTTCTGACTCCAGCAGAGAGAAAATGCTCCAGGTTATGTGAAGC
AGAATCATCATTTAAATATGAGTCAGGGCTCTTTGTACAAGGCCTGCTAAAGGATTCAACTGGAAGCTTT
```

Figure 20 (Continued)

```
GTGCTGCCTTTCCGGCAAGTCATGTATGCTCCATATCCCACCACACACATAGATGTGGATGTCAATACTG
TGAAGCAGATGCCACCCTGTCATGAACATATTTATAATCAGCGTAGATACATGAGATCCGAGCTGACAGC
CTTCTGGAGAGCCACTTCAGAAGAAGACATGGCTCAGGATACGATCATCTACACTGACGAAAGCTTTACT
CCTGATTTGAATATTTTTCAAGATGTCTTACACAGAGACACTCTAGTGAAAGCCTTCCTGGATCAGGTCT
TTCAGCTGAAACCTGGCTTATCTCTCAGAAGTACTTTCCTTGCACAGTTTCTACTTGTCCTTCACAGAAA
AGCCTTGACACTAATAAAATATATAGAAGACGATACGCAGAAGGGAAAAAAGCCCTTTAAATCTCTTCGG
AACCTGAAGATAGACCTTGATTTAACAGCAGAGGGCGATCTTAACATAATAATGGCTCTGGCTGAGAAAA
TTAAACCAGGCCTACACTCTTTTATCTTTGGAAGACCTTTCTACACTAGTGTGCAAGAACGAGATGTTCT
AATGACTTTTTAAATGTGTAACTTAATAAGCCTATTCCATCACAATCATGATCGCTGGTAAAGTAGCTCA
GTGGTGTGGGGAAACGTTCCCCTGGATCATACTCCAGAATTCTGCTCTCAGCAATTGCAGTTAAGTAAGT
TACACTACAGTTCTCACAAGAGCCTGTGAGGGATGTCAGGTGCATCATTACATTGGGTGTCTCTTTTCC
TAGATTTATGCTTTTGGGATACAGACCTATGTTTACAATATAATAAATATTATTGCTATCTTTTAAAGAT
ATAATAATAGGATGTAAACTTGACCACAACTACTGTTTTTTTGAAATACATGATTCATGGTTTACATGTG
TCAAGGTGAAATCTGAGTTGGCTTTTACAGATAGTTGACTTTCTATCTTTTGGCATTCTTTGGTGTGTAG
AATTACTGTAATACTTCTGCAATCAACTGAAAACTAGAGCCTTTAAATGATTTCAATTCCACAGAAAGAA
AGTGAGCTTGAACATAGGATGAGCTTTAGAAAGAAAATTGATCAAGCAGATGTTTAATTGGAATTGATTA
TTAGATCCTACTTTGTGGATTTAGTCCCTGGGATTCAGTCTGTAGAAATGTCTAATAGTTCTCTATAGTC
CTTGTTCCTGGTGAACCACAGTTAGGGTGTTTTGTTTATTTTATTGTTCTTGCTATTGTTGATATTCTAT
GTAGTTGAGCTCTGTAAAAGGAAATTGTATTTTATGTTTTAGTAATTGTTGCCAACTTTTTAAATTAATT
TTCATTATTTTTGAGCCAAATTGAAATGTGCACCTCCTGTGCCTTTTTTCTCCTTAGAAAATCTAATTAC
TTGGAACAAGTTCAGATTTCACTGGTCAGTCATTTTCATCTTGTTTTCTTCTTGCTAAGTCTTACCATGT
ACCTGCTTTGGCAATCATTGCAACTCTGAGATTATAAAATGCCTTAGAGAATATACTAACTAATAAGATC
TTTTTTTCAGAAACAGAAAATAGTTCCTTGAGTACTTCCTTCTTGCATTTCTGCCTATGTTTTTGAAGTT
GTTGCTGTTTGCCTGCAATAGGCTATAAGGAATAGCAGGAGAAATTTTACTGAAGTGCTGTTTTCCTAGG
TGCTACTTTGGCAGAGCTAAGTTATCTTTTGTTTTCTTAATGCGTTTGGACCATTTTGCTGGCTATAAAA
TAACTGATTAATATAATTCTAACACAATGTTGACATTGTAGTTACACAAACACAAATAAATATTTTATTT
AAAATTCTGGAAGTAATATAAAAGGGAAATATATTTATAAGAAAGGGATAAAGGTAATAGAGCCCTTCT
GCCCCCCACCCACCAAATTTACACAACAAAATGACATGTTCGAATGTGAAAGGTCATAATAGCTTTCCCA
TCATGAATCAGAAAGATGTGGACAGCTTGATGTTTTAGACAACCACTGAACTAGATGACTGTTGTACTGT
AGCTCAGTCATTTAAAAAATATATAAATACTACCTTGTAGTGTCCCATACTGTGTTTTTTACATGGTAGA
TTCTTATTTAAGTGCTAACTGGTTATTTTCTTTGGCTGGTTTATTGTACTGTTATACAGAATGTAAGTTG
TACAGTGAAATAAGTTATTAAAGCATGTGTAAACATTGTTATATATCTTTTCTCCTAAATGGAGAATTTT
GAATAAAATATATTTGAAATTTTG

>gi|153251839|ref|NM_018335.3| Homo sapiens zinc finger protein 839 (ZNF839),
mRNA
GGCCGCCATGGCGGATGCGGAGCCGGAGGCTGGGGGCGGCAGCGAGGATGCGGCGGCGGCGGCGGCCCG
GCTCCTCCGGGCCAGAGCGGCAGCGTCGCACGTGTGGCCCCGCTGGGCCCCGAGCAGCTGCGGCAGGTCC
TGGAGCAGGTGACGAAGGCGCAGCCGCCGCCGCCGCCGCCCCCTTCGTGCTGCGGGACGCGGCGCGGCG
GCTGCGGGACGCGGCCCAACAGGCCGCCCTGCAGCGGGGCCGGGGCACCGAGCCCCGCGCCTGCCGCGC
CTGCTCCCGCCCCAGCAACTAGAAGCCATTTGTGTCAAGGTAACGTCTGGAGAAACAAAAGGTCAGGAAA
GGCCAATGCTCCTACCGACCACAATCCAGCCCCAAACTGCAAGAAAGAGCCAGCTGCCCCGGGGGAATTC
```

Figure 20 (Continued)

```
CTGCCTGGTGGGGCTCCATATCGCCAGCCCTCAGCTGCTCAGGGTACAGCCGCTTGTGAGAACCGAGCCA
CAGTCCTGCTTCCTAAGTGACTTATGCCAACCTCCTGCTCAGGGGTTTGTACAGAGACCACTGCCAGCCC
TCCAGGTGGTCCCTGCAAAGAGAGTCCCAGCCCCCAAGGCTCCAGATGAACAGGGCTCCATGTTGACCCC
TTTGTCTGCCTCTGACCCGCTGGCAGTAACATCTCTTTCATCCAGTTCAGCACATCCATTTATTTCCAAC
TTGCATACAAGACATACTGAGAAACTAAAAAAATCGTTAAAAGTAAAGACACGTTCTGGACGGGTATCTC
GACCTCCCAAATATAAAGCTAAAGATTATAAGTTCATAAAAACAGAGGATCTGGCGGATGGTCATCTGTC
AGATTCTGATGATTACTCAGAACTCTGTGTGGAAGAAGATGAAGATCAGAGGGAGAGGCACGCACTCTTT
GACTTATCGAGCTGCTCCCTGAGGCCCAAAAGCTTTAAGTGTCAGACTTGTGAAAAGTCATATATAGGGA
AGGGGGGACTGGCCCGACATTTTAAACTTAACCCAGGCCACGGCCAGTTGGACCCCGAGATGGTGCTGTC
TGAGAAAGCCAGTGGAAGCACCCTCCGGGGGTGCACGGAGGAAAGGACGCTCAGCCTGACCTCCCTGGGG
CTGTCCATGCCAGCGGATCCATGTGAGGGAGGGGCCCGCTCCTGCTTGGTGACAGAGTCAGCACGCGGTG
GCCTGCAGAATGGTCAGTCTGTAGACGTTGAAGAGACATTGCCATCTGAACCAGAAAATGGAGCTCTTTT
GCGATCAGAGAGATACCAAGGACCTAGAAGACGCGCATGCTCAGAGACCCTTGCAGAGTCCCGCACAGCT
GTCCTCCAGCAGAGAAGAGCTGCTCAGCTACCTGGTGGCCCTGCTGCGGCAGGGGAGCAGAGGGCGTCGC
CAAGCAAAGCCAGGCTCAAGGAGTTCCTCCAGCAGTGTGACCGGGAGGATCTGGTGGAATTGGCTCTGCC
TCAGCTGGCTCAGGTTGTGACCGTGTATGAGTTTCTTCTGATGAAGGTTGAAAAAGATCATCTAGCAAAG
CCTTTTTTCCCAGCTATATATAAGGAATTTGAAGAGTTGCATAAAATGGTTAAGAAAATGTGCCAAGATT
ACCTCAGTAGTTCTGGTCTGTGTTCCCAGGAGACCCTGGAAATAAACAATGATAAGGTTGCTGAGTCATT
AGGAATCACAGAATTCCTACGGAAGAAAGAAATACACCCAGACAACCTTGGACCCAAGCACCTCAGCCGA
GACATGGATGGGGAGCAGCTAGAGGGAGCTAGCAGCGAGAAGAGGGAACGTGAGGCTGCGGAGGAGGGAC
TGGCCTCAGTGAAAAGGCCCAGAAGAGAAGCCCTGTCCAACGATACCACTGAATCTCTTGCTGCCAACAG
CAGAGGCCGGGAGAAGCCCAGGCCCTTGCATGCTTTGGCCGCTGGTTTTTCCCCTCCAGTAAATGTGACT
GTCTCTCCCCGTTCTGAAGAAAGCCATACAACGACGGTTTCTGGTGGCAATGGGAGCGTGTTCCAGGCGG
GCCCGCAGCTTCAGGCACTGGCTAACTTAGAAGCCAGGAGGGGGTCTATAGGTGCTGCTCTCTCATCCCG
GGATGTCAGTGGGCTGCCTGTTTATGCTCAGTCAGGAGAGCCTAGGAGGCTGACCCAGGCACAGGTGGCA
GCGTTTCTGGAGAGAATGCTTTGGAACACTCTTCAGACCAGGACACCTGGGACAGCCTGAGGAGCCCGG
GTTTCTGCAGCCCTTTGTCATCTGGTGGTGGAGCAGAGTCCCTGCCGCCTGGGGGCCTGGACATGCAGA
GGCAGGACACCTCGGCAAGGTTTGTGACTTCCACCTGAACCACCAGCAGCCCAGCCCCACCAGCGTCCTG
CCTACAGAGGTGGCAGCCCCTCCGCTTGAGAAAATTTTGTCTGTGGATAGCGTGGCAGTGGACTGTGCCT
ACAGGACTGTGCCCAAGCCAGGGCCTCAGCCTGGCCCACATGGATCACTATTGACTGAAGGGTGTCTCAG
AAGCCTTTCGGGGGACTTGAACCGGTTCCCCTGTGGGATGGAGGTGCACTCTGGCCAGAGAGAACTGGAG
AGCGTGGTTGCTGTCGGCGAAGCCATGGCTTTTGAAATTTCCAATGGGAGCCATGAGTTACTGTCTCAGG
GACAGAAGCAGATTTTTATTCAGACTTCCGATGGGCTTATCTTGTCCCCTCCAGGTACAATAGTGTCTCA
GGAGGAGGACATTGTCACAGTGACTGATGCAGAGGGGCGTGCCTGCGGATGGGCCCGCTAGAAGGAGTTC
CTCTAGAAGCTGTGGAGTCGGTCGTCACCGTGGAGCCAGAGCCCTCACAGTGAAGTGGAGTCAGATCCTA
GATTCGTCTGATTTTATCCAGAGAAGGTCTATGGCAAGCAATGTATATTTTTCTAATGTGAATATTGCAC
AGATGAACCTTTTATTTATAAAGAATAATGTCTTTCTGCCCTGCTGTCTACATTTTTCTATGGAGCTTGT
CATAATAATAGCAGATATTACCTGATCAGGAATCCCTGTGGCGCGTCTGACGCTCATGAGTTTTTCATGA
TGGTGATGAGTAGCACTGCACTGTCACCTGATGATTGGCCCTGCTCCGTTTCCCTTCTCTCCTGGGAGAT
ATGCTGCTTTTCCACCAGACTTGCTCCATACTAGAAGCTTCTTTTGGGTTCAATTAAAAAGAAAATAAGC
TAGTCATTCTGGGCAGCATTTTATTGATAGAAGGGGGAAAAAGTCATTTCTACTTGCATGATTTTTTAAA
TTAAATTAAATTAAATTAATTTAATTATTAAAAAAAAAAAAAAAAAAAA
```

Figure 20 (Continued)

```
>gi|224493894|ref|NM_018393.3| Homo sapiens t-complex 11 (mouse)-like 1
(TCP11L1), transcript variant 1, mRNA
ATGTTTTCCACCTCTCCCTGAGGAAACACGGCGCCGCCCAGCTGCGAGTCACCGCTTACTGAACCCCTTC
GGCAAGCAGGGGAAAGACCCTCCCGCCTTTCCGTACGAAGACATGGCGCTGCCCTATATTGGGCTGGCGC
CTCCCGGCCAAGAGCAGTCTCCTCCTTCCTGATGCTGAGAAGCGGCCGCTCTGACCGCTGCCCACCCGAG
TCGGGCTGGGAGGACCGCCCGCCGCGTGGCGAGGGATGCGGCCTCGGAGGGGCAGAGGCTGAACCGCCCC
TGCCTGCCGCGCATCCCTCCGGCTTCCGCCGCGGCGCCAGCCCGCGCCTGATTCGCGGCGGGAGCGGCAG
GAGGGAGAACGCCGACTCCGTGGCAGGAAAGTGAATAAACTTAATTGAGAATGTCTGAAAACCTTGACAA
GTCCAATGTAAATGAAGCAGGAAAATCAAAATCCAATGATTCTGAGGAAGGCCTCGAAGATGCTGTGGAA
GGTGCTGATGAAGCCTTACAAAAAGCAATAAAGTCAGACTCCTCCAGCCCCCAAAGAGTGCAGAGACCTC
ACTCTAGTCCTCCTCGCTTTGTGACAGTAGAAGAACTTCTAGAGACAGCGAGAGGTGTCACCAACATGGC
TCTAGCCCATGAAATTGTAGTAAATGGAGACTTTCAGATTAAACCAGTTGAATTACCAGAAAACAGCTTG
AAGAAGAGAGTAAAGGAGATTGTACATAAAGCGTTTTGGGATTGCTTGAGTGTGCAGCTAAGTGAAGATC
CCCCAGCATATGACCATGCTATCAAACTTGTAGGAGAAATCAAAGAGACTCTCTTATCTTTCTTGCTGCC
TGGTCATACTAGACTGAGAAACCAGATAACAGAAGTCTTGGATCTGGATCTGATAAAGCAGGAAGCAGAG
AATGGGGCGCTAGACATTTCCAAGCTGGCAGAATTCATTATTGGCATGATGGGACACTGTGTGCACCTG
CTCGAGATGAGGAAGTTAAGAAACTAAAGGACATTAAGGAAATAGTGCCCCTTTTCAGAGAAATTTTTTC
TGTGTTGGACCTAATGAAAGTGGACATGGCCAACTTTGCTATCAGTAGCATCAGGCCTCATCTCATGCAG
CAGTCAGTTGAATACGAAAGGAAGAAGTTTCAAGAGATTTTGGAGAGGCAACCAAATTCCCTGGACTTTG
TCACCCAGTGGCTGGAAGAAGCCTCAGAGGACCTTATGACTCAGAAGTATAAACACGCCCTGCCAGTGGG
GGGAATGGCTGCTGGCTCTGGGGACATGCCCAGGCTGAGCCCTGTTGCTGTCCAGAATTACGCTTACCTG
AAGCTTCTGAAGTGGGACCACCTCCAGAGGCCGTTCCCCGAAACAGTTTTAATGGACCAGTCTCGCTTCC
ACGAGCTCCAGTTGCAGCTGGAACAACTGACCATCCTGGGGGCTGTGTTGCTGGTCACCTTCAGCATGGC
AGCGCCAGGAATTTCCAGCCAGGCCGACTTTGCTGAGAAACTCAAGATGATTGTGAAGATTTTGCTAACA
GATATGCACCTGCCCTCCTTCCATCTGAAGGACGTCCTCACTACCATCGGGGAGAAGGTGTGCCTGGAGG
TGAGCAGCTGCCTCTCCCTGTGTGGGTCCTCTCCCTTCACCACGGACAAGGAGACCGTGCTCAAGGGCCA
GATCCAGGCCGTGGCCAGTCCCGATGACCCCATTCGCAGGATCATGGAATCTGAATCCTGACCTTCTTA
GAAACCTACCTTGCCTCGGGTCATCAGAAGCCATTGCCCACAGTCCCTGGGGGACTCAGTCCAGTTCAGA
GAGAGCTGGAGGAAGTTGCTATTAAATTTGCTCGCCTGGTCAACTATAACAAGATGGTCTTCTGTCCCTA
CTACGATGCAATCCTGAGTAAGATCCTCGTCCGATCCTAACGTGTATGCACCCTACAGCAGCAGTATTAC
TCACTAGCCACAGAATACCTGTTCTGTACTCTAATGTTGCATTGGAAAATGGCTATATAGTACATGTCTA
TTTAACAGCACCGATTCCAAAGGGAAGAATATTGTGTATCACTGTTGAAAAGACTTGTTGAGAAATCCAC
TGAATTCTATTTTGAGAGATTGTATTTATGAGTGCAAGTTTACAAATCAAAGAAGCATTTTGTTCTCGAG
TTTTACAGGTAACACTCAGCTGTTGTCTCCACTCCTCCCCCATCATGTCCTTCCAAGGAGGCTGGGACCT
CTCTCTTCTGCAATCTGGGTAGTTCTTTCAGATGCCTCATGCTGAGCTGACGGCCATCCAAGCGCAAAG
AGACCAAGCCATGGCCTCACCTCCTGCCCTCCCTCAGACAGCCTTGTCCCTCACCCCTCCCTTCTGGTAT
TTTTGTTAGAAGGGCTATATAACGTCTTATTGCCATTTTCTCCCCCTATTTATTGCTTCCTCCCTGCCTG
GCCTAGCCAGGGCTCCCAAGCCCTTTTTTCTAGAGGAGAGTTATTTGTCTCTCTCTCTTTTTTTTTTTAC
TTTCTTTTTTGTATTTAAACATTCTTTTAACCTTCCCCAAAGATACAGTTATTGGACTTTAAAAAGCTT
GTTCTTTTATACAAAATTACTCCTGCATCTGGTTGAGAGCAGTTATGACTTATGAGATCTAGTGAAAGGA
AAGTCTTTGACTTTCAAGCCTTGAAAGTCAAGGAGGAAATGTATTGAAAAATAGTTTACTGTAATGTGAA
```

Figure 20 (Continued)

CGAAGAGAAATGTCTGGAATTCTTACTGAAAAATTGACCCTGAGACAATACACAGATGTGATGATTGAAT
TAAATTCTGGAATTAGA

>gi|258613877|ref|NM_018452.4| Homo sapiens transmembrane protein 242 (TMEM242),
mRNA
CAAACCAGCCTCCCAGCGGAAGACCAAGCTTGCTAGCGGTCAACGTTGCCGGCAGCTCTGCAAGCGCTTC
CAGCGGGCGTCGCTCTCCTTTCGGGGGTGGTACTTTCATTCGGTCATCCTGTGAGTGTTCCACTTCCCGA
CGGAGGCCGAGCACTCACACCGCGGCGGAGGTACCCGTCACCGCAGAACCGGGTGGCTGGCTCTCCTCCA
GGGAGAAAGCCTGTCACTTATTCCTCAACACTGTTGGGAAGTTACCTAGAAAAGTACAGACAGAAGACCT
AGGCTTGCGTTTTAGAATCGTGGAGTGTTAGCGCTGGCCAAATCGTTGGACACAATGTAAGCTTGATCAG
GAAAATGAGCTCCAGGGTCTCACAGGCGGGGCCTGGAATCTTGGCGCAATCTGCGACCCTCACTGCCTCC
TACAGTCGGGGCTGAGCGTTCTTTCAAACAGCCAAAGTAATCACTTAAGTCCAGCAATGATCTCCTTGGA
GAAATCAAAAGATCCTCCCTAAGAGACGGCCTTGGAGGGCATCGCCCCTGGGGCTGGGCACAGCACGTCT
TCCCGGCCCCGGCGCGGGAGGAGGGTTTGGGGACAGCGGCCGCACTCCGGACCCTTCTTCAGATTGCACA
GGAGGAGGCGGTAGCGGAACCTTTCTCCTCCGCCTGGTTCTCGCTTCCACCCGGGCCCAGTTGGGGACGG
ACGCACTAGAGGCGACCTAAACATGGAGACAGCGGGCGCTGCAACTGGGCAGCCGGCCTCTGGGCTGGAG
GCTCCGGGGTCCACGAATGACCGGCTTTTCCTGGTTAAAGGTGGAATTTTCCTTGGTACCGTTGCTGCAG
CGGGAATGCTAGCTGGATTTATTACAACATTATCATTGGCTAAAAAGAAAAGCCCTGAATGGTTCAATAA
GGGAAGTATGGCCACGGCTGCATTACCGGAAAGCGGGTCTTCCCTTGCCTTGCGAGCTCTGGGCTGGGGC
TCCCTGTATGCATGGTGTGGGGTTGGTGTGATTAGCTTCGCAGTCTGGAAAGCTTTAGGAGTTCACAGTA
TGAACGACTTTCGAAGTAAAATGCAATCAATATTTCCAACAATTCCCAAGAACTCCGAATCGGCTGTTGA
GTGGGAGGAAACATTGAAATCCAAATGAGATGAGCATGGATGAATTTCAAAATGCTTGTTACAGAAAGGG
GTGGCTCTGGAGACACCATGACAGCAAAAGGACTGGGACTGATTTCTCCCAGGAACATGGGCAGATTGCT
GACTGAACCAGTGCACTGGATAGCATTCAGCCTCATCACAGGAGAGTATGTGTGTGCGTGCTGGGGGAGG
GTAAAGTTTTCCCACAGTTAAGAAGACTATTTAAAAATAGTAATTACAGGAATAACTTCCTTATGTGGAG
GGGACCCCATAGGAAATGATTCTGTTTGTAACAGTTGAAGCAAATTTCATACTAAAAAAGTTTATAATAA
AAGTATGATAAGAAAATATTTATAAAACAGACCCCCTAATAGCAATAGTACTGCAATGTGTCTAATTAAA
GGAGTTTCAAGAGCCTTTCTTGTCAATATATGACAGAACTTGGAAGTCTTATTCTGATTAGCCAGACTAC
AAAGTGACAGTCACCTGGTAAGTCCTGTATGGTAGGAAGTGGGTGTGGCTCTCGGGTCCTAAATGTGGTC
TGTGCTTTACAGCCATCACACACATGCTAGTTATTTACCTGATGCCCTTGCTTGAAGGCCCTATAAATTC
TTATACTTAAAACAAAAAGCCAGTAATGAGTTGTGATCACCCCAAAAGGCACAGTTGGGCTAAAATAATG
ATGATATCAGGGGTAAACATATTTTTTTGAGAAGTTGGTCTGGATCTCTGAACACTGACAATTTGTCATT
TTGTCTCAGTTGTCAAAGTAAAAAAAGCCCAGTTGTCATCCGTCTTCAATATTTTAACCAGAAAGTCAC
CTGAGTACGGAGTCCCAATATAAAGTATTTGGGACCACCTCCCTAACAAAGCTGTTAGGGTAAATTCTGT
GTGCACGCCCAACTCCCTCCTGTCTTCCACAGTCTCCTACAAAAAAAACAGATGGAGAATAATGTCTACA
TGCAATTGTTTTTACTGCAATTGTATTTTAAAATATTTTCAAGAAGAGAAATACTTTAATATGTCAATAT
GTCCAGAGAAAAAACCTGTAGTTAAATATCAGTTGTGCAATTTCTTCCTACTTGCCTAGGCTCTAATTAG
TCAGCAATCAGGTTTAATAAAGGACATTTGAAATTTCTGTTATCATGAAACCTTTTATTCTAAGGGAGAT
TTTTAAATGAAATGACAAGAACTTAATGTAATACTTTTCTAGACCATGTTACCCTGTTAAAATTGCTG
TATTGTTAATGAAACAGGTGTAATCAGCATCTGGAATTCATATGTAATCTGTTAAAAATCCAAGACTGAA
AGGAAAGGATTGTGAAATTGGTCAGTGAATGCGGGTAGCAAAAACTCTTCACTGCCTTTCATTTGTAACT
AAATCTCCTCTGAGAAGAGATCTGTAGGCTTTGAATGAAAGGAAGGAAAGGCAGGAGCCAAAGGAACAGG

Figure 20 (Continued)

```
TTTTCGTCCATACAATTAGTCTGAATCTAGGTTCCTCTGAATAGAATGGGCACCGCCTGATCCTTTTGTG
CTTCATAAATGTGGGTTTCCAACGTGCATGAGATGGCCCTCAAACCTTGTTACAACGATGCACTTTACTC
GTTTGATGTGGGGGGAAAAAGAATGGGCACTACCTAAAACTGTTTACAGCTAGAATCTGGGTTTTATTTT
TCATAGATGGAGAATGCCTAGTGGTTTCTAAAGGCCTCCACTGGGTGGAGAAAGGAGACTTGCCCACCTG
TCTGGAGTGTTAAAAGGAGAAATCATTGTTAACTGATTCTGTTAATGGATTCCTGCCTTGTAACCTCCCG
AAGGGCAGGGACCCCTCTCAGGGCCTTGTAAACTGGTGTCAGCACCGCTGCAGAGGCTGCTGCACATCAG
GCTGATGGCAGCTAGGCCCTAGGAAGGAGCCAGGGGCCATGGTGGGGCTCTGCTTTCCCACAGGGCTGG
CACAGAGGAGGCCTAGACATATGTTGCTGAAAGAGTGTCCTAATACTAGAGTGGCATGCCTCGTGTCTAC
AAAACCCTTATATGTCACCTCTGCTGTCCTTGACCGATGGCAGGGGAACTCCCATTAGAATGATGATGAA
TCCCCTGCAGAGGGGAGGCTGGCAGGGACAAATTCCCTAAAAGAGGGACCAAGCGTCAGCTCCAATTGCA
TCTTAAAAGCAAAGGTGAAGTAATGCACAGATGGAAATTTAAAAAGAAAACAAGCAGTATGACTCAAGTG
GTGTTTTTCACAGTCAGAACTTGAATATCAGTAGATTTCGTCATTTGTCTATTCCTTTTGTACCAGAGGC
ATATTGTTAAATTGGTTAATGGAAAGGAAAAATGTTGAACAGATAATGTTATTCTTTATGAGACGTACCA
TCTGTGTATTGAGCTCTGAATGTCCCTGGATATGGAAGAGAGGAAATGTGATGGAATTTCAAGTTTGCCT
TCTTTGCTGTCTTTATCTTGGGTTGAGTATGACAAACATAATCACATTTATCTCCTGGAGCATAAAGAGT
TTTAATCACCCTATTAACCAGGATGACATTTTTCACAGACTTAAAAAGGAATAGAACAGACATTATCTCC
CTATAAGCAATCCATTTCATGGAGGCTGAGCACTAGAAATGCTTTAAAGGATGGATAACGCAGGCCATTT
CCATTTCCTGTCTAAGCCAACATTAAGGAGGCTTTCGGTAAGGCTGTTGCTTCCACTGGGTGAGTGTTAA
GCTTTACACTTAGAGTCTCAGCGCCCAAAAGAGCTATTAGAGAAAGCACGGGCAGGGAGGAGTGGCTTCC
GAGACCCCAGGATTCATTCAAGGGAAAACATGTATCCTGGTAAGTTGCTGCTGCCCTGTGAAAAGGAGTC
CATAGGCTGCTGTTATATTCAGAGTCAAGAAAGTGTGGGTTCAGGACAACCTGAGAGTGGAAAGTGGGGG
ACGGGAGCTGCCTCCGAAGACGCCCGGCAGCCCATCACCAGGAGGACCATGGCCCAAGGGCATGGAAGCA
TGTGGCTGCTGAGAGGGTCGTGGGCCATCTCCACCACCACCCTCGCGTCAGGGCATGGGCCCAGGCTGGC
GTTAAGGGCACTTTGCCTGCTTAGTCAAAAGGTGGCATCGAATCACCTGGGCTGTCACATGTTTTGTTTA
GTTTCATGGATAGTATGGGACCAAACTTGCAAATTAATCATTGCAATCTAAGGGGAAAATAGAAGAAATT
AAGGTGGGGGTGGGGGGACGGGGAGCCCATGGGGATAAAAGTAATTAAAATCCATTGAATTTAGCTATTT
CACTTGGGGCAACATTTAATCTCCAAGATTAAATCTTGGTTTATGGGGAAGGTTATATATTTTCATCTCA
TTTTTATGTATCATCTTTAAGACAAATTGTTAAGTACAAATGAAAATCAGGTAACATACAAAGGCATTTC
ATCAAATAGTTAAATTTCCTATGAAAGTTAGTAAAATACATATTTTTATAATACCATGTTCAAGTGAAGT
GTTTTTGCTTTCTGCCAAGAGTCATTAAATGATATAGCAAGTATTTGGGTCTCTCTTGGTGTTATCAGGA
TTAATTGCCCAAGGCTGCGATTTTGTGAGCATAGAAGAGGAAAGCAAGCATCTCTCACAAGCAGTGACAT
GAATCTGTAATAATGAGTGAGGCTGTTAGCAAATTTTGTGTGATGGCAGATAACTCAGTTTTGGAGAAAA
TTAGAATCACAGCTACCAAGAAGCACATATCGTTTCAACTTTCCCACCCAAGTATTAGTGAAGTGATTTA
GGACCTTGATTTATATTTCTTAGAGAAGCTGGCTCGAGGCCTTTGTTTCATTACTGTTTGATGAGGCATG
ATCCCTTACTTTAAAAAAAAAAAAAGGTGAATGTATTAAATGTACTTAAAGACATAAAAAAAAAAAAAAA
AAAAAA

>gi|253970483|ref|NM_018990.3| Homo sapiens SAM and SH3 domain containing 3
(SASH3), mRNA
GTATGCTGCTGCTGCCGGGTGTCCATGGCCCGCACCCCAAGCTGCCACTGCAGCAGTCAGAGTGGCAGC
TGAAGGCTCGGTTCATGCCGTGCCCCCGGGCAGTTCTGGTGAGGCTAAGCAAGAGGCCTCTGCATCTTGA
CACCTAGGAGAGCAGGGACGGAGTCTCCCAGGGTGGAGGACCATGCTGCGCCGCAAGCCCTCCAATGCCA
```

Figure 20 (Continued)

```
GTGAGAAGGAGCCCACTCAGAAGAAAAAGCTCTCCCTTCAGCGCTCCAGCAGCTTCAAGGATTTTGCCAA
ATCCAAACCCAGCTCCCCCGTGGTGAGCGAGAAGGAGTTTAATCTGGATGATAACATTCCAGAAGATGAC
TCAGGTGTCCCCACCCCAGAAGATGCTGGGAAGAGTGGCAAAAAGCTGGGGAAGAAGTGGAGGGCAGTGA
TTTCCCGAACCATGAACAGGAAGATGGGCAAGATGATGGTGAAGGCCCTGTCAGAAGAGATGGCAGACAC
TCTGGAGGAGGGCTCTGCCTCCCCGACATCTCCAGACTACAGCCTGGACAGCCCTGGCCCTGAGAAGATG
GCGCTGGCCTTTTCTGAGCAAGAGGAGCATGAACTTCCGGTGCTCAGCCGCCAGGCATCAACAGGCAGTG
AGCTCTGCAGCCCCAGCCCAGGTTCTGGCAGCTTCGGGGAGGAACCACCTGCCCCCCAGTACACAGGGCC
TTTCTGTGGCCGGGCACGAGTCCACACCGACTTCACTCCCAGCCCCTATGACCACGACTCGCTGAAACTG
CAGAAAGGAGATGTGATCCAGATCATTGAAAAGCCACCTGTGGGCACGTGGCTGGGCCTACTCAATGGCA
AGGTGGGCTCTTTCAAATTCATCTATGTGGATGTGCTGCCCGAGGAGGCCGTGGGGCATGCCCGCCCCAG
CCGCCGACAGAGCAAGGGCAAGAGGCCCAAGCCTAAGACCCTGCATGAGCTGCTGGAGCGCATCGGCCTG
GAGGAGCACACATCCACCCTCCTGCTCAATGGCTACCAGACACTGGAAGACTTCAAAGAGCTGCGAGAAA
CACACCTCAATGAGCTGAACATCATGGATCCACAGCACCGGGCCAAGCTGCTCACGGCCGCCGAGCTGCT
GCTGGACTATGACACTGGCAGTGAGGAGGCTGAAGAGGGCGCCGAGAGCAGCCAGGAGCCAGTGGCACAC
ACAGTGTCGGAACCCAAGGTGGACATCCCGCGCGACTCAGGCTGCTTTGAGGGCTCGGAGAGCGGGCGCG
ATGACGCAGAGCTGGCAGGCACTGAGGAGCAGCTGCAAGGCCTCTCCCTGGCCGGGGCACCTTGAGGTGG
CGGTGGCAATAGGCCAAGGCTGGGACCCAGCTGCAAAGGCTGTAGGAGTGGGCCCAGCCTCCCGTGGTGG
CCCAGGTCCTGAGGACTGGCACTGAGCCTGGCCCTGCTTCCCAGGGACACTTAGGGCCACAGAGGCCAG
GCCAGGGCCCTACAGGTTCCAGGCTCAGCTGGAGTGGTTGGGGAGTCGCCCAAGGGCACATCCCACCTGC
CTGAGCCCCGCCCTCCACCAGCGACTGACAGCGCAGCCCTCCTGGCACCAACTGCTCCCCTGCCATGGC
CACGGCCACAGCAAGTGGGGCACTGGGAAACCCTGCCCATGTCCCTCACCAACAAGGCCTCCAAATCCTC
CTCACCCCCACACCACCTACCCCTGTCGCACTGCTCCTGAAAAGGGGGCCAAGTCAATGTTTCAGGTCAG
TCTAAAAACCCTAGGGAAGCTGGCCATTTAAAAGAACCCAAACTGACCATGGGTAAATCCAGTTCCCCTA
AATAAGGCCTGAAGAAATCCACAGGTACCATTCCCACTTTCCTTCTCCCTAGCTTTCTTAGAGGTTTGGC
CACTAAATCTTATGAGACTTGAACCAAGTGGCTTCCTCTTTCTAGGCTTAGGACGGGTTGGGGTTAGAAA
GGGTGATCACTGAAGGCCTTGCCTGCTCTGACATTCTGTGACATTAAATGTCTATTCTCCTGTTACCTGT
GGCCTGGGACACCAGTGGGGTTTATCGAGGGGACCAGAGGGGCCTCAGGCTTTCAGATGAAATGGCTCCT
CCTACTCACCCACTTTATTCCTCTCCATGTAATTCAGGACAAGCTGCAACTTCCCCCAGCTTAACACAAT
GCCCATACCTCATACGATATGCGCCCTCCCGTTCCATCCCTGGCCCCCTCAAACGAGACTTCTCACAAGG
CTGATTACAGATGGTCAAACCTGGCTTCCAAGGACAGAATTGCCTCTCGGAAGCCAGCTGTGGATCTGAG
TCCAGAGTTGGCCACTTGTGTGGGTCCTCACAAGCAAAGAGAGCACTAAACTTGACATTGGGGGTCCACC
ACTCCAACTTTGCTTTCTGAAGGTTTTGGTGTACATTGAGCCCCAGAAGGAAAGGAGAGTATCTGTGAGT
GGGGGCCTCCCTTGACCCCAGTACGAAGTCTATGCCCTGAATCCCCAGAGTAGCCCTTCCTGGTGCCCAA
CTGGCCTGGGACAAACAGCGTCCACTACATCTAGGACTGCCGGCTAAGTGGACACACTTCTTGACCTCC
TACCAGGAACTTTGGTAAAAGCTAGCTTTGGGGAAGGGGTTGGGTGTAAATATGAGAGGGTGGAGGGAGA
CCAGCTGGTAGCAATAAACATGGGTAGAACTAAAAAAAAAAAAAAAAA

>gi|356582286|ref|NM_019000.4| Homo sapiens family with sequence similarity 134,
member B (FAM134B), transcript variant 2, mRNA
ATCCAATGAAGGTTACTGGCTGAGCGGGACACCTTCTCACAGGACTGGAGAGAGAATGCGGGGCAGCTG
GGCAGGGCTCACTTCCAGCCGCCTGTCACAGTACTGGGAGTAAGAGGTGACCTATTTATTTTTAGAAGGG
GGCAGTGATAATAACCCAGCTCCTAGCTTCATTCAAGGGAGGCAGGCGCTTTGGAAGTTTGTAAACACCA
```

Figure 20 (Continued)

```
ACTTTCTGAGTAAGGGAGGAGCACTTTTTTTCCAAAAAGGAAAGAACGTCTCTACTGGGTTTTTTTCCTC
CTGATATTCAGCATTAGAGTAGAAAAGAAACTATTGTTTGGCCACATTAGCCGTGGTTAGCAGGTGCTGC
AGCCTTTGCCACTGTTATTATTTTTAAAGGGCAGAAATGCCTGAAGGTGAAGACTTTGGACCAGGCAAAA
GCTGGGAAGTTATCAATTCCAAACCAGATGAAAGACCCAGGCTCAGCCACTGTATTGCAGAATCATGGAT
GAATTTCAGCATATTTCTTCAAGAAATGTCTCTTTTTAAACAGCAGAGCCCTGGCAAGTTTTGTCTCCTG
GTCTGTAGTGTGTGCACATTTTTTACGATCTTGGGAAGTTACATTCCTGGGGTTATACTCAGCTATCTAC
TGTTACTGTGTGCATTTTTGTGTCCATTGTTTAAATGTAATGATATTGGACAAAAAATTTACAGCAAAAT
TAAGTCAGTTCTGCTGAAACTGGATTTTGGAATTGGAGAATATATTAATCAGAAGAAACGTGAGAGATCT
GAAGCAGACAAAGAAAAAAGTCACAAAGATGACAGTGAATTAGACTTTTCAGCTCTTTGTCCTAAGATTA
GCCTCACGGTTGCTGCCAAAGAGTTATCTGTGTCTGACACAGACGTCTCAGAGGTATCCTGGACTGATAA
TGGGACCTTCAACCTTTCAGAAGGATACACTCCACAGACAGACACTTCTGATGATCTTGACCGACCCAGT
GAGGAAGTTTTCTCTAGAGATCTTTCAGATTTTCCATCTCTAGAAAATGGCATGGGAACAAATGATGAAG
ATGAATTAAGCCTTGGTTTGCCCACTGAGCTCAAGAGAAAGAAGGAACAGTTGGACAGTGGTCACAGACC
AAGCAAAGAGACGCAATCAGCAGCTGGTCTCACCCTTCCTCTGAACAGTGACCAAACCTTTCACCTGATG
AGCAACCTGGCTGGGGATGTTATCACAGCTGCAGTGACTGCAGCTATCAAAGACCAGTTAGAGGGTGTGC
AGCAAGCACTTTCTCAGGCTGCCCCCATCCCAGAAGAGGACACAGACACTGAAGAAGGTGATGACTTTGA
ACTACTTGACCAGTCAGAGCTGGATCAAATTGAGAGTGAATTGGGACTTACACAAGACCAGGAAGCAGAA
GCACAGCAAAATAAGAAGTCTTCAGGTTTCCTTTCAAATCTGCTGGGAGGCCATTAATCTAGGAATCAGC
TTGCAACAGAGCACAAAAAACACCAAAAAATTTCAAACAAGAAAAAAAAAAAAAAAGGAAAAGAAAAA
AATTGAACTGTAAGCTTTAATGATTACTTTAGATTTGTTTTATTTTCCCTCCTGCAGTGAATTAATTGGA
TATATATCAGCTGACACTGATAGATTGATATTTCTGATCGTTATTTTTGTGTAATAAGCATGGAAATGAA
CTTTATACACACCACTGTGTTGTCAGAGATAAATATTAGGGGTTGTTTTAAAGCAAAAAGAAAAAAACA
AAAACCAAACTATTAAAATCCTCCTATAAATATTCTTTTTCTTTACAGTTTTTCAAGCATGCAAAACAGT
TTATTGTAACTTACTGAAAAATATTAACAATTAATTGTGAATACATGCTGTTACCAGCTTCCTTATTCCT
AATACCTGGAAAATTTTTTTTTCAACGGATAGATTTTGATGTAAAAAAGACCGAAATTATCAAGGTATCT
TAGTTGAAGGACTTGGGAAATACTATCAAAATTAATTTCTTAGGAAAAAATTTAAAAGTATATTTAAGTA
CTCTGGATAGACTGAAACGTTTCCATGTTATTTCTGCAGTTGTAGACTTAGGCTTATTTGTAAAGAAGCA
TGCTCCATTGACTGCCATCTCTAGTCTTGCAGTGGGTGGTATTAACCCATAGAAAGCAAGCAGTTGTGTA
TCACATAGACAATGGTTATGATGTAAACAGATTCAGTTGTTTTGTTGTTCATTCGTCATATGTTTGTGAT
AGGGATGTTGGGAGCACAGCTCTATTCTGCCTGCTCAGACTTAAGTTAGACCCTTATCTTTTATATTATG
TCATGAAAAAAGTCTCCTAAAATTGTGAAACTAGTTCTTGATGAGTGATGTGATCATCAGCAATAAAGAT
ATAATAACTCTGTTTTCTTAGCCTGTATAGAGGAGAGGAACTTGCTTGGCTTTAAAATATATTTATTTGC
CATTTAAGTATAAATATGGAATCTGTTTCTTATTGGGAAGATAGAATATATATATTTTCCTTTAAACTTT
TTAAGGTCACTTTTAAATAACCAAATTTGATTTATGGTTTTTAACAAAGGACTAAAGAGCTGAAACCAAC
CTAGTTTTGTTTTTGTGATATAAACTTTAAGTGTCGAGGGACCATGCCAGCAACTACCAAAAATCTCTTA
AATCTTCAGGTACAGCTGGCATTTTGGCAGATGCATAGAGACATCTGAGACCCTCAGAAAGGAAGGATAA
TCCAAGAATATAGGAAATCTGTGTTCTCTTCCTTTCATTTATCCCTTATATTTCTAAAGACTAATTATA
AGTAATCTGACATTTTAATGTAGCTACTCTTATTTATTTTTTCTTTCTGAGGTATTAAAATATCTGGACT
GAGTTTTGCCAAATGTTAAAGGGAGAAGAGTTACTGAAGACTTTGAACACTTGCTTTTTGTGATTGCTTA
TGTCATTAGTGCCTCATGACTGTGTTTGATGTCCTTTATTGATACAAAGTGAGCCTGTGCCTTCATTATC
TTGCCCATTTTAATACAAATGGAAACCTGGTGTTTGAAAATCTCTGAACTGTGTGGGTTTTGGAGGAATA
TACCTGAATTTTATTCAATAACAGTTTCTGGACAGGAAGAAAAATACAGTTACATATTTATAAAATAGTC
```

Figure 20 (Continued)

GTTATCAGTAAAAAAAAAAAAAAAAAAAAAAAAA

>gi|109150418|ref|NM_019005.3| Homo sapiens missing oocyte, meiosis regulator, homolog (Drosophila) (MIOS), mRNA
GCCATCTTGCCCGCGTCCGGGCTCCTGCGGCGGGCGGGGCGGTGTCCCGGCCGGAAGCGGCTGTGCGGCG
GCCGCGCTGCCACCTCAGGGAAATTTGGATATGTGCAGTGCATCTCCTCGAAGATGCTGATGGTGGAAAT
TTCTTGAAACCGCTCTCGTAATTTGCCACGTGCTGTTGCAAATATTCTGGTGAATGAACACAGAATCAGC
ATGGCTTTCCTTTGCTGAGAAATCACTGATGGGAAGTGAGACTTGTTAAACTTGAAAGTGAATGGACCTG
AGTGGACCCTTTGATCACATCAGTAAACATGAGCGGTACCAAACCTGATATTTTATGGGCACCACACCAT
GTTGATAGATTTGTTGTGTGTGACTCAGAACTAAGTCTTTATCATGTGGAATCTACTGTGAATTCAGAAC
TCAAAGCTGGATCTTTACGTTTATCTGAAGACTCTGCAGCTACATTACTGTCAATAAATTCAGATACACC
CTATATGAAATGTGTTGCCTGGTATCTTAATTATGATCCTGAATGTCTGCTGGCAGTTGGACAAGCAAAT
GGTCGAGTTGTACTTACAAGCCTTGGTCAAGATCATAACTCAAAGTTCAAAGATTTGATAGGAAAAGAGT
TTGTTCCAAAACATGCACGACAATGTAATACCCTTGCCTGGAATCCACTGGATAGTAACTGGCTAGCTGC
TGGTTTAGATAAGCACAGAGCTGACTTTTCAGTGCTAATATGGGATATCTGCAGCAAATATACTCCTGAT
ATAGTTCCCATGGAAAAAGTGAAACTTTCAGCAGGTGAAACTGAAACAACATTATTAGTAACAAAACCAC
TTTATGAGTTAGGACAGAATGATGCTTGTCTGTCTCTTTGTTGGCTTCCACGAGACCAGAAACTTCTCCT
TGCTGGTATGCATCGTAACCTAGCTATATTTGATCTTCGGAATACAAGCCAAAAGATGTTCGTAAATACA
AAAGCTGTTCAGGGTGTGACGGTAGACCCATATTTCCACGATCGTGTTGCTTCCTTCTATGAAGGTCAGG
TTGCAATATGGGATCTTAGAAAATTTGAGAAGCCAGTTTTGACATTGACTGAGCAACCAAAACCCTTAAC
AAAAGTAGCATGGTGTCCCACTAGGACTGGTCTACTTGCCACTTTAACAAGGGATAGTAATATTATTAGA
TTGTATGATATGCAGCATACACCCACTCCCATTGGGGATGAAACTGAACCCACAATAATTGAAAGAAGTG
TGCAACCTTGTGACAATTACATTGCTTCCTTTGCGTGGCATCCAACAAGTCAAATCGAATGATAGTTGT
AACTCCCAACCGAACAATGTCAGACTTCACTGTTTTTGAAAGGATATCTCTTGCCTGGAGCCCAATTACA
TCTTTAATGTGGGCTTGTGGTCGTCATTTATATGAATGTACGGAAGAAGAAAATGATAATTCTTTAGAAA
AAGATATAGCAACGAAGATGCGTCTTCGGGCTTTATCAAGGTATGGACTTGATACAGAGCAGGTGTGGAG
GAACCACATTTTAGCTGGAAATGAAGATCCACAGCTCAAGTCACTCTGGTATACTCTGCACTTTATGAAG
CAATACACAGAAGATATGGATCAGAAATCTCCAGGCAACAAAGGATCATTGGTTTATGCAGGAATTAAAT
CAATTGTAAAGTCATCGTTGGGAATGGTGGAAAGCAGCAGACATAATTGGAGTGGGTTGGATAAGCAAAG
TGATATTCAAAATTTAAATGAAGAGAGAATCTTAGCTTTACAGCTTTGTGGGTGGATAAAGAAAGGAACG
GATGTAGACGTGGGGCCATTTTTGAACTCCCTTGTACAAGAAGGGGAATGGGAAAGAGCTGCTGCTGTGG
CATTGTTCAACTTGGATATTCGCCGAGCAATCCAAATCCTGAATGAAGGGGCATCTTCTGAAAAAGGAGA
TCTGAATCTCAATGTGGTAGCAATGGCTTTATCGGGTTATACGGATGAGAAGAACTCCCTTTGGAGAGAA
ATGTGTAGCACACTGCGATTACAGCTAAATAACCCGTATTTGTGTGTCATGTTTGCATTTCTGACAAGTG
AAACAGGATCTTACGATGGAGTTTTGTATGAAAACAAAGTTGCAGTACGTGACAGAGTGGCATTTGCTTG
TAAATTCCTTAGTGATACTCAGTTAAATAGATACATCGAAAAGTTGACCAATGAAATGAAAGAGGCTGGA
AATTTGGAAGGAATTTTGCTTACAGGCCTTACTAAAGATGGAGTGGACTTAATGGAGAGTTATGTTGATA
GAACTGGAGATGTTCAAACAGCAAGTTACTGTATGTTACAGGGTTCACCTTTAGATGTTCTTAAAGATGA
AAGGGTTCAGTACTGGATTGAGAATTATAGAAATTTATTAGATGCCTGGAGGTTTTGGCATAAACGAGCT
GAATTTGATATTCACAGGAGTAAGTTGGATCCCAGTTCCAAGCCTTTAGCACAAGTTTTTGTGAGTTGCA
ATTTCTGTGGCAAGTCAATCTCCTACAGCTGTTCAGCTGTGCCTCATCAGGGCAGAGGTTTTAGTCAGTA
TGGTGTGAGTGGCTCACCAACGAAATCTAAAGTCACAAGTTGTCCTGGCTGTCGAAAACCACTTCCTCGA

Figure 20 (Continued)

```
TGTGCGCTTTGTCTCATTAATATGGGAACACCAGTTTCTAGCTGTCCTGGAGGAACCAAATCAGATGAAA
AAGTGGACTTGAGCAAGGACAAAAAATTAGCCCAATTTAACAACTGGTTTACATGGTGTCATAATTGCAG
GCACGGTGGACATGCTGGACATATGCTTAGTTGGTTCAGGGACCATGCAGAGTGCCCTGTGTCGGCATGC
ACGTGTAAATGTATGCAGTTGGATACAACAGGGAATCTGGTACCTGCAGAGACTGTCCAGCCATAAAATG
TTACCACCTTAAGAGAACCCTTCAAGTGTGGAGCTTTCTAGTAGGTGTCCTTCATAGCTCAGAAACATAC
CTCAGAACAAGCCATTCATGACTTACCTGTAATGGGAAAATAAATCATTCTATCAGATCAGCAGTTTTGA
TGTTTGAGTGATTTTGATATGCTTCACAGAGACAAATGCTGCCAAAATAAACATCGAAGTATAGACATGA
GTTCTGTTCAGCAGGTTGAAAAGTCTGATTTAGAAAAACTTTCTAAGTTTTGGTTGAAATTATGAACACT
CTAGAAGCAGAATTTCTGGAAGAGCCAAGAACAGACTTTGAGCCTATATCTTCAAAGCTGAAACTGGATA
TCTTTCAATAAAATATGTGCACTTTTAAAATAAAAAAAAAAAAAAAAAAA

>gi|93588627|ref|NM_019895.2| Homo sapiens claudin domain containing 1 (CLDND1),
transcript variant 2, mRNA
TATCGCCGCCTCAGACAGCTTTCAGTCTGTCCCTCCTACAACTCCCACAAGGCCCCTCGGCCCCGGCCG
CGGCCCGGCCCGGAGTGGGGGCGGGCGGAGGCGCGGGAGTTATGGAGGGGGCGGGCTCTGCAGGGAAGTG
CGTCAGAGGAGGCGCGGGGAGAGTAGGGTGCTGTGGTCTGAGCTAGAGGGTGAAGCTGGCGGAGCAGGAG
GATGGGCGTATGCAGGTGATAGACTAGAGAACAAGACCTCTGTCTCCGTAGCATCCTGGAGCAGTCTGAA
TGCCAGAATGGATAACCGTTTTGCTACAGCATTTGTAATTGCTTGTGTGCTTAGCCTCATTTCCACCATC
TACATGGCAGCCTCCATTGGCACAGACTTCTGGTATGAATATCGAAGTCCAGTTCAAGAAAATTCCAGTG
ATTTGAATAAAAGCATCTGGGATGAATTCATTAGTGATGAGGCAGATGAAAAGACTTATAATGATGCACT
TTTTCGATACAATGGCACAGTGGGATTGTGGAGACGGTGTATCACCATACCCAAAAACATGCATTGGTAT
AGCCCACCAGAAAGGACAGAGTCATTTGATGTGGTCACAAAATGTGTGAGTTTCACACTAACTGAGCAGT
TCATGGAGAAATTTGTTGATCCCGGAAACCACAATAGCGGGATTGATCTCCTTAGGACCTATCTTTGGCG
TTGCCAGTTCCTTTTACCTTTTGTGAGTTTAGGTTTGATGTGCTTTGGGGCTTTGATCGGACTTTGTGCT
TGCATTTGCCGAAGCTTATATCCCACCATTGCCACGGGCATTCTCCATCTCCTTGCAGGTCTGTGTACAC
TGGGCTCAGTAAGTTGTTATGTTGCTGGAATTGAACTACTCCACCAGAAACTAGAGCTCCCTGACAATGT
ATCCGGTGAATTTGGATGGTCCTTCTGCCTGGCTTGTGTCTGCTCCCTTACAGTTCATGGCTTCTGCT
CTCTTCATCTGGGCTGCTCACACCAACCGGAAAGAGTACACCTTAATGAAGGCATATCGTGTGGCATGAG
CAAGAAACTGCCTGCTTTACAATTGCCATTTTTATTTTTTAAAATAATACTGATATTTTCCCCACCTCT
CAATTGTTTTTAATTTTTATTTGTGGATATACCATTTTATTATGAAAATCTATTTTATTTATACACATTC
ACCACTAAATACACACTTAATACCACTAAAATTTATGTGGTTTACTTTAAGCGATGCCATCTTTCAAATA
AACTAATCTAGGTCTAGACAGAAAGAAATGGATAGAGACTTGACACAAATTTATGAAAGAAAATTGGGAG
TAGGAATGTGACCGAAAACAAGTTGTGCTAATGTCTGTTAGACTTTTCAGTAAAACTAAAGTAACTGTAT
CTGTTCAACTAAAAACTCTATATTAGTTTCTTTGGGAAACCTCTCATCGTCAAAACTTTATGTTCACTTT
GCTGTTGTAGATAGCCAGTCAACCAGCAGTATTAGTGCTGTTTTCAAAGATTTAAGCTCTATAAAATTGG
GAAATTATCTAAGATCATTTTCCCTAAGCATTGACACATAGCTTCATCTGAGGTGAGATATGGCAGCTGT
TTGTATCTGCACTGTGTCTGTCTACAAAAAGTGAAAATACAGTGTTTACTTGAAATTTTAACTTTGTAA
CTGCAAGAATTCCAGTTCAGCCGGGCGAGGATTAGTATTATTTTTAACTCTCCGTAAGATTTTCAGTACC
ACCAAATTGTTTTGGATTTTTTTTCTTTCCTCTTCACATACCAGGGTTATTAAAAGTGTGCTTTCTTTTT
ACATTATATTACAGTTACAAGGTAAAATTCCTCAACTGCTATTTATTTATTCCAGCCCAGTACTATAAAG
AACGTTTCACCATAATGACCCTCCAGAGCTGGGAAACCTACCACAAGATCTAAAGTTCTGGCTGTCCATT
AACCTCCAACTATGGTCTTTATTTCTTGTGGTAATATGATGTGCCTTTCCTTGCCTAAATCCCTTCCTGG
```

Figure 20 (Continued)

```
TGTGTATCAACATTATTTAATGTCTTCTAATTCAGTCATTTTTTTATAAGTATGTCTATAAACATTGAAC
TTTAAAAAACTTATTTATTTATTCCACTACTGTAGCAATTGACAGATTAAAAAAATGTAACTTCATAATT
TCTTACCATAACCTCAATGTCTTTTTTAAAAAATAAAATTAAAAATGAAAAGAGACTCAATTGTAAAAAA
AAAA

>gi|217416367|ref|NM_020150.4| Homo sapiens SAR1 homolog A (S. cerevisiae)
(SAR1A), transcript variant 2, mRNA
GGGGAGGGGTGTGACGTACATCCGGCGAGTAGCTGGCGGTCCCGGGTGCTGCTGGTTAGTGTGCTCTGAG
GGAGGGTCCGAGCCAGCCGCTGTTTTGCCGGAGGAGCCCCTCAGGCCGTAGTAAGCATTAATAATGTCTT
TCATCTTTGAGTGGATCTACAATGGCTTCAGCAGTGTGCTCCAGTTCCTAGGACTGTACAAGAAATCTGG
AAAACTTGTATTCTTAGGTTTGGATAATGCAGGCAAAACCACTCTTCTTCACATGCTCAAAGATGACAGA
TTGGGCCAACATGTTCCAACACTACATCCGACATCAGAAGAGCTAACAATTGCTGGAATGACCTTTACAA
CTTTTGATCTTGGTGGGCACGAGCAAGCACGTCGCGTTTGGAAAAATTATCTCCCAGCAATTAATGGGAT
TGTCTTTCTGGTGGACTGTGCAGATCATTCTCGCCTCGTGGAATCCAAAGTTGAGCTTAATGCTTTAATG
ACTGATGAAACAATATCCAATGTGCCAATCCTTATCTTGGGTAACAAAATTGACAGAACAGATGCAATCA
GTGAAGAAAAACTCCGTGAGATATTTGGGCTTTATGGACAGACCACAGGAAAGGGGAATGTGACCCTGAA
GGAGCTGAATGCTCGCCCCATGGAAGTGTTCATGTGCAGTGTGCTCAAGAGGCAAGGTTACGGCGAGGGT
TTCCGCTGGCTCTCCCAGTATATTGACTGATGTTTGGACGGTGAAAATAAAAGAGTTTTACTTCTCTGGA
CTGATCCTATTCACAGCTTCCTCATGAACTTTTCTAATAGAACAAGGAAAGCTCTCCAACCATGTCTGGC
GTTGAGAAGCCAAGAGTCTCTGTCAACTCTCTCATTGCCCAGTGGTGACATGTGCTCTTCTCCACACTGT
TGGGAGGTAATGCTGCCCCACGTGCTGGTGCAGGTCAGTATCCTGGGACTTGGAAGCTGGCAGGATTTGC
CGGGTAAAGCTGTATGCCATCATGGGGCACCTGAAAAGAAAAACACGTCTCACCACTGTGGTTGATTCAA
AAGAAAGTGATTCTATTTTTTAAAGAAAGCGTTGTTAATGTAATTGGTATCCCTCCTAACTTTTTGAGTT
CACAATTTACTTGGTCCAGAGTTTTCTATTCTTTTTTTTTTTAAACTAATGAATGACATTTAGATACTT
CATAAAATTATGAACAGATATGGAGGCCAGAGCTCATTTGGGTAAACTTACTCCTGCTGAGTTAGCAGGT
TGGTGAGAGAAGCTCCCCTGAGCTCACCTGTCTCTCTGACTGCCTTGGAGTAGGTGGCATAACCTTGTGC
ACAGAGAACTAGAAAAGGGGCAGAACCCCGGCCTTGCAGTTGTGGCAGGTTTCCACTGTGGTAAGCTAGG
TTCATTCCTCATCAAGGAATGTGTAGCAGATTGTTCACTGTGGAGGAGTTAATTATAGAATGGGTTATTG
TTGTTATTCTTACTCATGAAGTTACAGATTTAGCCAGTCTTTGCTTTTATACTTTGTGAAATTTAATT
TCTCTCTATAGCACCTTCCTTTTTCGTTTTCAGTTATCAAAAGTGACTTTGACCTCATAAAAGAGTTGAG
AACATCTCTCGTGTCACATACTGCAGGTGCATCAGTTACTTTTGCACAGATTCTAGGGGGACATTTTTCT
GAATAGGAAGACAGGACAAAGTTAACAGCTTAAGGGCTCTTAATTCTGTGAGTTGAGGACTTAAAAGTAT
TGTAGCATTTGTTTGGATCCATGAAAAATGTATTCAGTGGGCTTTAAAATTTCCATTTGCAGAATTTGGT
CTCTCAGGCTGTTTGGGAGCTCTTTTTTTACATTTTTTCTCCTTTGACACCTATTTTATTGGTGTTTAA
AGTAAAGGTTAACATCTGTAGCTTTTCCAGGTTTTTTTTTTTTTTTTTTTTTTGGTATGAAATTGTC
TTTCTCCATTGCAGAAATAAGCTAGGGAAACACTAACCCAAAAACTTTCTGTAGAGCTGTTCCTTTGGAG
GCAGCATCACTTATTGGCAGTAAAGACTCAGTATAAAAGCACCGGCATCCCTACTTGGGTGATGGGGATT
AATTTTATAGCATTCCATTTTCCTAGTGCCACATGTGAAATTGGATTTTGATGATCTTAATCTATATTCT
ACCCTTATAATAAAAGATCAAAAGATATATCTCCTATGAACAGATTGGAGATAGGAGATGAAAAGTTGGG
AGGATGTCTTTATTCTAATGTGAGGGTAGGGAAAATGTGGATAACATTACTGGGTGAGGGAGGCATTGT
TCTTTAGTTGGAGTTCTCATTCTTATTCTCCAGTACTGACTTGTGGGAAAGCATACTTTTCACTGCCA
GGTACTGAATGCAGAGGCTCAGTGAAGTATATATGTGGGAAGTGCATGCATTTCGTTTATTAGCAAACAT
```

Figure 20 (Continued)

```
AGCTGGATTAAGACAAAGTTGTTGGTTTGGAAAGGGGTTAAAGCCTTAAGTGAACAAATCTAGCTAACAG
TGAATGAACTAGGTAATATAACTTGCATATTTTTAATTTCCTTTGGTTAAAGGTCCCCCATACTTCTCTG
TTCGGAGACATGAGAAGTATGATTACTTCAGTGTTAGTTTTCTTAATTTTTTTTTCCCCTATTTGTCCC
TTGTCACTTTGTTGCAAGCTAGAAATCTGTGGGTTATACATAGGGCAGCTCTTTGTGAAAGTGGTTTATT
CCACTGGAGAAAGGGGATTGAAAATCAGTTAGAACCAATGTATTTCTTGCCCCACGGAACACTATTCCTA
TAAGATAGCTGAAAGAAGCTGCTGTGAGGAGCTCAGCTCCAAACACAGGATCAGCACCTTGTATAGGAAT
TCCCATGAATTATGACTTCTCATTCTGTTTTATCAGAGTGCATATATGTCCTACTTCAGGAAAAGTAAAA
CAGTCATTTACGAAAGAAAGTCAATCTGTATCCTAAGCATTTTAATAAAAAGTTAAAACAAAAAAAAAA
AAAAAAAA

>gi|34147625|ref|NM_020185.3| Homo sapiens dual specificity phosphatase 22
(DUSP22), mRNA
CCGAGCCTAGTGCCTCCCACGCCCGGCGGCCGCGAGCCGGGGTCCGCGAGGGCGGAGTGGGGCGCGGCAG
CCAGGAACCCGACTACGAATCCCAGGGTGCGGGCGGGCGGAGCGAGGAGGGACGCTGGGCCTGCCCGGTG
CGCACGGGGGCGGGGACCGGCAAGGCGGGACCATTTCCCGGCATAGGCTCCGGTGCCCCTGCCCGGCTCC
CGCCGGGAAGTTCTAGGCCGCCGCACAGAAAGCCCTGCCCTCCACGCCGGGTCTCTGGAGCGCCCTGGGT
TGCCCGGCCGGTCCCTGCCGCTGACTTGTTGACACTGCGAGCACTCAGTCCCTCCCGCGCGCCTCCTCCC
CGCCCGCCCCGCCGCTCCTCCTCCCTGTAACATGCCATAGTGCGCCTGCGACCACACGGCCGGGGCGCTA
GCGTTCGCCTTCAGCCACCATGGGGAATGGGATGAACAAGATCCTGCCCGGCCTGTACATCGGCAACTTC
AAAGATGCCAGAGACGCGGAACAATTGAGCAAGAACAAGGTGACACATATTCTGTCTGTCCATGATAGTG
CCAGGCCTATGTTGGAGGGAGTTAAATACCTGTGCATCCCAGCAGCGGATTCACCATCTCAAAACCTGAC
AAGACATTTCAAAGAAAGTATTAAATTCATTCACGAGTGCCGGCTCCGCGGTGAGAGCTGCCTTGTACAC
TGCCTGGCCGGGGTCTCCAGGAGCGTGACACTGGTGATCGCATACATCATGACCGTCACTGACTTTGGCT
GGGAGGATGCCCTGCACACCGTGCGTGCTGGGAGATCCTGTGCCAACCCCAACGTGGGCTTCCAGAGACA
GCTCCAGGAGTTTGAGAAGCATGAGGTCCATCAGTATCGGCAGTGGCTGAAGGAAGAATATGGAGAGAGC
CCTTTGCAGGATGCAGAAGAAGCCAAAAACATTCTGGCCGCTCCAGGAATTCTGAAGTTCTGGGCCTTTC
TCAGAAGACTGTAATGTACCTGAAGTTTCTGAAATATTGCAAACCCACAGAGTTTAGGCTGGTGCTGCCA
AAAAGAAAAGCAACATAGAGTTTAAGTATCCAGTAGTGATTTGTAAACTTGTTTTTCATTTGAAGCTGAA
TATATACGTAGTCATGTTTATGTTGAGAACTAAGGATATTCTTTAGCAAGAGAAAATATTTTCCCCTTAT
CCCCACTGCTGTGGAGGTTTCTGTACCTCGCTTGGATGCCTGTAAGGATCCCGGGAGCCTTGCCGCACTG
CCTTGTGGGTGGCTTGGCGCTCGTGATTGCTTCCTGTGAACGCCTCCCAAGGACGAGCCCAGTGTAGTTG
TGTGGCGTGAACTCTGCCCGTGTGTTCTCAAATTCCCCAGCTTGGGAAATAGCCCTTGGTGTGGGTTTTA
TCTCTGGTTTGTGTTCTCCGTGGTGGAATTGACCGAAAGCTCTATGTTTTCGTTAATAAAGGGCAACTTA
GCCAAGTTTAAAAAAAAAAAAAAAAAAAAAAAAAAAAAAAA >gi|169808398|ref|NM_020381.3| Homo sapiens prenyl (decaprenyl) diphosphate
synthase, subunit 2 (PDSS2), mRNA
GGCCGCATTCCATGCCTCCAATATGGCGTCCTCCACATAGGCAGTGGCTGTGGTTTCTACCCCGGGTGGC
CGGGGGCAGTGCTGAGCTGGACTGTTGTTTGCCCAGCCTGGGCTGCAGAAAGCAGCAGTTAAAGTTCGT
TTCTGGTCACTGCTCCAGGAAGCCACCTTACTCTGAGGGTCAAGAATTGCCGCTTCCTTTTAGTTACTGT
AAGTTCCTCCTCTGCCCCTGGTTTGTTTCCCGCGGCACTTCTGGATACCCCCAGGTCCCAGACCCTTCCA
GACTCAAACCATGAACTTTCGGCAGCTGCTGTTGCACTTGCCACGTTATCTTGGAGCCTCGGGTTCCCCG
```

Figure 20 (Continued)

```
CGTCGCCTGTGGTGGTCCCCGTCCCTCGACACCATCTCCTCGGTGGGCTCTTGGCGTGGTCGGTCCTCCA
AGTCCCCGGCCCACTGGAATCAGGTAGTGTCAGAGGCGGAGAAGATCGTGGGGTACCCCACGTCCTTCAT
GAGCCTTCGCTGCCTGCTGAGCGACGAGCTCAGCAACATCGCTATGCAGGTGCGGAAGCTGGTGGGCACT
CAGCACCCTCTGCTTACCACAGCCAGGGGCTTGTACATGACAGCTGGAATAGCCTCCAGTTGAGGGGCT
TGGTGGTGCTCCTTATCTCTAAAGCAGCTGGGCCCAGCAGCGTGAACACTTCATGTCAGAACTATGACAT
GGTCAGTGGGATCTACTCATGTCAAAGAAGTTTGGCAGAGATCACGGAGCTAATTCATATTGCTCTCCTT
GTACATCGTGGGATAGTAAATTTAAATGAGTTGCAATCATCTGATGGTCCACTGAAAGACATGCAATTTG
GAAATAAAATTGCTATCCTGAGTGGAGACTTTCTTCTAGCAAATGCCTGCAATGGACTAGCTCTGCTACA
GAACACCAAGGTTGTGGAACTTTTAGCAAGTGCTCTTATGGACTTGGTACAAGGAGTATATCATGAAAAT
TCTACTTCAAAGGAAAGTTATATCACAGATGATATTGGAATATCGACTTGGAAGGAGCAGACTTTTCTCT
CCCATGGTGCCTTACTAGCAAAGAGCTGCCAAGCTGCAATGGAATTAGCAAAGCATGATGCTGAGGTTCA
GAATATGGCATTTCAGTATGGGAAGCACATGGCCATGAGTCATAAGATAAATTCTGATGTCCAGCCTTTT
ATTAAAGAAAAGACCAGTGACTCCATGACTTTTAATCTAAACTCAGCTCCTGTAGTCTTACATCAGGAAT
TTCTTGGAAGAGATTTGTGGATTAAACAGATCGGAGAGGCTCAAGAAAAAGGAAGATTGGACTATGCTAA
GTTGCGAGAAAGAATCAAAGCTGGCAAAGGTGTGACTTCAGCTATTGACCTGTGTCGTTACCATGGAAAC
AAGGCACTGGAGGCCCTGGAGAGCTTTCCTCCCTCGGAGGCCAGATCTGCTTTAGAAAACATTGTGTTTG
CTGTGACCAGATTTTCATGACATCAAATTAAAAAGACACTATTGTTAGTTAGCTGAAAATCCTAGGGAAT
GAGGTTGATTGGGAGCGCTTTCACGATGCGTTAATGACTTTTAAAACATATGCATTTTTCCTTCCTTTTA
TCACATTGCTAAATGAGTTCTGCTTTCTTTTGGAACTGCTACAAACAAAATTAGAAGAAAAAAAGGTCA
AGCAGTTTTCACTTGTCACGCCAGAAGCACACTTGAGGCTGCAGTCGCAGAAATAATTAATGAGATTCGC
TCCTGTGACCTCAGCAAATGGACAGGAAATAAGTCCTTATTGATTGGACCGAGCCAGGGATGGCGCCAGG
GCGGTGGCCTGTGGTTTTTCCTGCTAGAGAGGACAAAGCAAGTTGGAAGCTGCAGGTGTCAAGAGAAATG
CTCTCAATACCAACCAGGGAGGATTGTCTAATCAAAAACTAGTGACCAATTTGTCATAATGGAGAGTAGT
TCAATGGATTGAGAAAAATATGTTTTATTTGTTGGCTTGTAATTATGTCTCTGGATTATTATTATTTTTT
TTTTAGATGTAGTTTTGCTCTTGTTGCCCAGGCTGGAGTGCAATGGTGCAGTTTTGACTCACTGCAACCT
CCGCCTCCTGGGTTCAAGTGATTCTCCTGCCTCAGCCTCCCGAGTAGCTGGAATTACAGGCACCTGCCAC
CACGCCTGGCTAATTTTGTATTTTTAGTAGAGATGGGGTTTCACTATGTTGGTCAGGCTAGTCTCGAACT
CCTGACCTCAGGTGATCCGCCTGCCTCGGCCTCCCAAAGTGCTGGGATTAGAGGCTTGAGCCACTGCACC
TGGCCTCATGTCTCTGGATTTATAATGCAGTATGAATATACTTTGTGCTTTATGGTTTTTATAATGTCTT
TTTGGAGAAATTGCCGAAAAGTTGCCAAATACTTGAAGTAGGAGATTAAAATGTTATCAAATGTTAAATT
GGTTATATTAGGAATAGTCTGTTTTTCTTTCCTGAAGATCAGTTTTTTTATTCAAACACATTTCAAAGAA
CCAAATTTTTTTTTTCTTTAAGGAAAAAGGAGCTTTTTTTCAAGTGAAATGTATTCATTTGTAATACTTT
GGTTTAAGGCATACTTTAATTTTTACGAGTTTCAGAAACAGAATTTTTGTACTAGGGAATTCATTGGTGA
GAGTGTTCTTTTAACCTCAGAATGTCAAATTTTGGTCTTGAACCACAGACATCCAATTACAGAAAGAATA
TAAGCAATCTCACAGGCCTGCAATCGGACACTGTCTCTGTGTGGTTCATAGGAGATGATTTTTGAGGTTT
GCACTCATGCAATTTGAGAACACCGTTGACAAGAAGGCTGAGTTTACATAAATGATCTAGATTGAAACTC
AGCTACCTTTCTTCCTCATGTGGTGTAATTACAGCCCTATCTGGAGACAGCGAATACAGCAAACAGATTT
TATTACCTAGTTCGCTCAAACACTACATGAAGTTATTTTAGTTAAAGCCCTCCCCCAAAAGTTATAAAAC
CATTTTATCAGGGCCCAACATGTGGCATGCAATGAAGAGAAAATGTAAAGCTACAGAGGTTAATGTATTG
TATTATAAAATATTTTAAGTGTACTCAAAATATCATAATTGTACAGTTTATGCCACCATAATTTGAGGCC
TATAGATTTAGCTTAAGAGAACACTGTTCTGTTTGAAATGCTTTCTGTCACTGAAATTGGCTTAATTAGT
AACCATGGATAAGATGCTTTAGATCAGACTAGGTTTTAATCATTAACTTCCACAAAGAAGTCATACTTTG
```

Figure 20 (Continued)

```
CGTTAGGTGTGCTGGTTGGATGTGCAGGAACTTCAGCAAGCAGTAGGTTTTACTAAGCAGATGGTCGGGC
ACTGCAGGGCACCAGGCAGGATCCTAGGGCGCCTCTTATTCTGCGTTAGCATCTGGTTTGCTGTATGACC
TTGCACAAGTCACTTCCTTCTGAGCCTCAATTTTCTCATCTGTACAATGAGATTCAAAAGTTGACCTGAA
AGTCAAGTGTGAAAAAAAAAAAGAGATTAAACAAGATAATTATGAAATTCTTAAAAAAAAAAAAAAAA
```

>gi|62952497|ref|NM_020397.2| Homo sapiens calcium/calmodulin-dependent protein kinase ID (CAMK1D), transcript variant 1, mRNA
```
AGCCGGCGCGCGGCGGCGGCAGGAAGTCTGTGCCCGAGAACAGCAGAAATAAGAGCCAGGGAGGGACCGC
GGCCGCGGCGGCGGCGGCGAGAGCGAAAGAGGAAACTGCAGAGGAGGAAGCTGCGCCGCAGCCCGAGCCG
CCCGGCATCCCCGCCGCCTCTGCGCCCGCGCCGCGCCCCCGGCGCCCCCTCCCAGCGCGCCCCCGGCCG
CTCCTCCGCGCCGCGCTCGTCGGCCATGGCCCGGGAGAACGGCGAGAGCAGCTCCTCCTGGAAAAAGCAA
GCTGAAGACATCAAGAAGATCTTCGAGTTCAAAGAGACCCTCGGAACCGGGGCCTTTTCCGAAGTGGTTT
TAGCTGAAGAGAAGGCAACTGGCAAGCTCTTTGCTGTGAAGTGTATCCCTAAGAAGGCGCTGAAGGGCAA
GGAAAGCAGCATAGAGAATGAGATAGCCGTCCTGAGAAAGATTAAGCATGAAAATATTGTTGCCCTGGAA
GACATTTATGAAAGCCCAAATCACCTGTACTTGGTCATGCAGCTGGTGTCCGGTGGAGAGCTGTTTGACC
GGATAGTGGAGAAGGGGTTTTATACAGAGAAGGATGCCAGCACTCTGATCCGCCAAGTCTTGGACGCCGT
GTACTATCTCCACAGAATGGGCATCGTCCACAGAGACCTCAAGCCCGAAAATCTCTTGTACTACAGTCAA
GATGAGGAGTCCAAAATAATGATCAGTGACTTTGGATTGTCAAAAATGGAGGGCAAAGGAGATGTGATGT
CCACTGCCTGTGGAACTCCAGGCTATGTCGCTCCTGAAGTCCTCGCCCAGAAACCTTACAGCAAAGCCGT
TGACTGCTGGTCCATCGGAGTGATTGCCTACATCTTGCTCTGCGGCTACCCTCCTTTTTATGATGAAAAT
GACTCCAAGCTCTTTGAGCAGATCCTCAAGGCGGAATATGAGTTTGACTCTCCCTACTGGGATGACATCT
CCGACTCTGCAAAAGACTTCATTCGGAACCTGATGGAGAAGGACCCGAATAAAAGATACACGTGTGAGCA
GGCAGCTCGGCACCCATGGATCGCTGGTGACACAGCCCTCAACAAAAACATCCACGAGTCCGTCAGCGCC
CAGATCCGGAAAAACTTTGCCAAGAGCAAATGGAGACAAGCATTTAATGCCACGGCCGTCGTCAGACATA
TGAGAAAACTACACCTCGGCAGCAGCCTGGACAGTTCAAATGCAAGTGTTTCGAGCAGCCTCAGTTTGGC
CAGCCAAAAAGACTGTGCGTATGTAGCAAAACCAGAATCCCTCAGCTGACACTGAAGACGAGCCTGGGGT
GGAGAGGAGGGAGCCGGCATCTGCCGAGCACCTCCTGTTTGCCAGGCGCTTTCTATACTTAATCCCATGT
CATGCGACCCTAGGACTTTTTTTAACATGTAATCACTGGGCTGGGTGCAGTGGCTCACGCCTGTAATCCC
AACACTTTGGGAGGCTGAGGCAGGAGGACTGTTTGAGTTCAGGAGTTTTAAGACCAGCCTGACCAACATG
GTGAAACCCCATCTCTACTAAAATATAAAAATTAGCCGGGTGTGGTGGCGAGCACCTGTAATGTCAGCTA
CTTGGGAGGCTGAGGCAGGAGAATCACTTGAACCCAGGAAGCGGAGGTTGCAATGAGCTGAGATCACACC
ACTGCACTCCAGCCTGGGTGACAGATTGAGACTCCCTCTCAAAAAA
```

>gi|299782545|ref|NM_020473.3| Homo sapiens phosphatidylinositol glycan anchor biosynthesis, class A (PIGA), transcript variant 3, mRNA
```
GACTCCGGCTGCAGCCGCGGGAGGTCCGGACACTGGCGGCCATGGAACTCACCGGGATCGATTTGCTTAG
TGGTATAATACCTGAACTCTGTCAGAAATATCCAGATTTAAATTTCATAATTGGAGGAGAGGGACCAAAG
AGAATCATTTTGGAAGAAGTTCGGGAAAGATACCAGCTGCATGACAGGGTGCGTCTTTTGGGAGCTTTAG
AACACAAGGATGTTAGAAATGTCTTAGTTCAAGGACATATTTTTCTGAATACCTCCCTTACTGAAGCATT
CTGCATGGCGATCGTGGAAGCAGCCAGTTGTGGTTTACAGGTTGTAAGTACCAGAGTTGGTGGAATTCCT
GAGGTGCTTCCAGAAAACCTTATTATTTTATGTGAGCCTTCAGTAAAATCTTTGTGTGAAGGATTGGAAA
AGGCTATTTTCCAACTGAAGTCAGGGACATTGCCAGCTCCAGAAAACATCCATAACATAGTAAAGACTTT
```

Figure 20 (Continued)

```
CTACACCTGGAGGAATGTTGCAGAAAGAACTGAAAAGGTATATGACCGGGTATCAGTGGAAGCTGTGTTG
CCAATGGACAAACGACTGGACAGACTTATTTCTCACTGCGGCCCAGTAACAGGCTACATCTTTGCTTTGT
TGGCAGTTTTCAACTTCCTCTTCCTCATTTTCTTGAGATGGATGACTCCAGATTCTATCATTGATGTTGC
AATAGATGCCACTGGGCCACGGGGTGCCTGGACTAATAACTATTCTCACAGTAAAAGAGGGGGTGAGAAT
AATGAGATATCTGAAACCAGGTAGAAGGAAGCCTAGATTGTAAGATTTTAAACATTTGTAATAGTTCTAT
AAAGACTATGGAAAATAACCTTGCTTTTGGGGGGTTTTGTTTTTTAGAGTTAATTTAGTAAGTTATGC
TACCTCTATATCATTCAATATTTTCTGTTGAGGAAAGATAAAAATGTATGCAATTCCTGAGTGTAGAAAC
TTCTTGCACTTATTTAAAATTTAGGAGAGAACATTTAAGCCACTCAGGTATGCAATTTTTCAGACTACTG
AAATCCCTGTAGCAGAGATGTTTTAACATTATATTTTGAGAGCTTTGGGTGCTGAAGGGCCAAACGTTTT
CTGGGCATTTTTTGGCCAGTTTTTAATGTAACACCATTAGACACTCACCAGATGTTTACAAGTTTTCTTT
AGGGGAACTACAACAATTATATGAACTGTTTTATATCATGTTCATATACATTTATTAGGAATCTAAATCA
TGTCTTTGAACATTTATTAGGTTCACTCAGTAGGTGTTACATGTAATTAACAGGTTCCTTGAGTAAGATA
GTCCATCAGTTACCAGCACATTTTGAACCCCTGCTCTGTGTAGAATGTTGAACTAGATGCTTCCCGCCAT
TAAGGACCAGGGGTGCATTCACTCTTTGTTTACCATTCAAATGGCTTACTTCATCATAATTGTGGTTGAT
ATGAGATCAATATCCAACATGCCAAAAATGCTCATGCCAGTTAATGCCAGGAAAAAAATCACCGACACAC
TACTAGTACTTTGTTCCTGTTGTATGCATTCTCCTAGGTAGAGCCTCCATCTTCAGTTGTGTTTGTGAAG
GTATTTTTGCTTTTAAATACTGGGGACCGATATCACTGTTGATAGTGCAGAGAAACCCTCCACATTTT
TCAGTGCATAATTGAGTTTTCTATAAATGCCTTCGTGTTTTCTGAGCAGAATGTACGAGGTGTGCCATCC
CAAAACCAGCTGCTACCCTGTCCTTTTAATGTAAGTCACTCCCCTTCACTGTGGCCTCGCTGATGTCTGA
TAAGTATTGTCAGTGTGCAAAAGGCTTTACTTCAGAATGGTTTATTTATAGCAAACTAAGTTGAAAATTT
TAGAAACAGTCTTTGTGGGTGGATGTTATTAACTGTCATTGTTGTTGCCCAGAGCCATGGGTTTTTTAAC
CCCAAATTATCCACATGGTGTGTATTATGAATTCTTTGAACTCTTAAGGTTTTTGTGAGAAAAGGACTGT
GAATTCAAAACAATAAGGCACTTGTGGGTGCACTACATAGATTCTGACAGTGTTGTGATTCTGTATAGGA
TTTTTAAAAATGACAACATTCACAAAATTTATTACTTTTTAAAAAATAACATGCCTATTAACTGGTTGCA
CTGATATAAAAGAAATATATTTGTGTTTTGTTTGTACTAAAATGCAAAAGCAAGAGTGCAATTTTTAAAA
TCTAGAAGTTAGGGGTTTTGTTGGAGAAAAATGGACTGATCTTTAAACTATTCAGTCTTACTGGGATTTT
TATGCATAGAAACTCACATATAAACATGAAATAAACAGTGCCAGTATTCATAGGAAAGTGAGAAACTGTA
ATATTTGGCCATTATTCTATTCAACAGGTTTTAGAGGCATGCCACCATTTTTTCCTTATATTTTGCTTA
ATTTTTTTAAATTGTCATTTAATTCTTAAACTGTCATTTATTTGAGATGGAAATAAGATCTAAAGTTAGT
TGCCTTTGCCTGTAAAACATGTGATTTGCAAATTATTATTTTTCTTTTTTTTAACAAATGGAAGTAAATT
TGTTTCACGTAAATCTTAATTTTCAACCTTTCTGGATACCTTAATTGTAACTGTCAGTTTGCACTGGTCG
GTATATGGAAACACATTGCTCTACCCTGCTACTTAGTTGATTTTAAAGTGAATTTACAGTGATGAGAAAT
TTGTGAAAAATATATTGTATTTCTTTTGATGTTTCAAAAGGTTGCCTATGAAAAACTGATTTGTTAAAAC
ATGCTACATGTCCAAAAATAAAGACCAGAATGACATTTTGATAATTTTCAAAAAAAAAAAAAAAAAAA

>gi|189027140|ref|NM_020676.5| Homo sapiens abhydrolase domain containing 6
(ABHD6), mRNA
ACCTCTGTAGGCGATCCTGCTCTCGCCGTGGCTTTCGGGTGCTAGGAGACAGTTGCCGGCGTTGGGTTGT
GCGAGACGCTAACTGTACCCTCCGGGTTTAACGCTGTGAGGCAGCGCGCGGAGGAACTGGGGATAAGCGC
CCCGGAGCCCCAAACAGAGCGCGGCCGCTGGGGACAGCGCGCGGCGCCGGGTCGGGCGGGGCGGCTT
TTCTGTCGGAGGACGCGAACCGGCACGCTGCGCCTTTAAGGAGTCCAGCTGGGCTGGGCGCCGGAGCTGG
GAGCGGCGCGGGTAGGAGCCCGGCGGCAGGTCCCAGCCCGGGGCTAGAGACCGAGGGCCGGGGTCCGGGC
```

Figure 20 (Continued)

```
CCGGCGGCGGGACCCAGGCGGTTGAGGCTGGTCAGGAGTCAGCCAGCCTGAAAGAGCAGGATGGATCTTG
ATGTGGTTAACATGTTTGTGATTGCGGGCGGCACGCTGGCCATCCCAATCCTGGCATTTGTGGCTTCATT
TCTTCTGTGGCCTTCAGCACTGATAAGAATCTATTATTGGTACTGGCGGAGGACATTGGGCATGCAAGTC
CGCTATGTTCACCATGAAGACTATCAGTTCTGTTATTCCTTCCGGGGCAGGCCTGGGCACAAACCCTCCA
TCCTCATGCTCCACGGATTCTCTGCCCACAAGGATATGTGGCTCAGTGTGGTCAAGTTCCTTCCAAAGAA
CCTGCACTTGGTCTGCGTGGACATGCCAGGACATGAGGGCACCACCCGCTCCTCCCTGGATGACCTGTCC
ATAGATGGGCAAGTTAAGAGGATACACCAGTTTGTAGAATGCCTGAAGCTGAACAAAAAACCTTTCCACC
TGGTAGGCACCTCCATGGGTGGCCAGGTGGCTGGGGTGTATGCTGCTTACTACCCATCGGATGTCTCCAG
CCTGTGTCTCGTGTGTCCTGCTGGCCTGCAGTACTCAACTGACAATCAATTTGTACAACGGCTCAAAGAA
CTGCAGGGCTCTGCCGCCGTGGAGAAGATTCCCTTGATCCCGTCTACCCCAGAAGAGATGAGTGAAATGC
TTCAGCTCTGCTCCTATGTCCGCTTCAAGGTGCCCCAGCAGATCCTGCAAGGCCTTGTCGATGTCCGCAT
CCCTCATAACAACTTCTACCGAAAGTTGTTTTTGGAAATCGTCAGTGAGAAGTCCAGATACTCTCTCCAT
CAGAACATGGACAAGATCAAGGTTCCGACGCAGATCATCTGGGGGAAACAAGACCAGGTGCTGGATGTGT
CTGGGGCAGACATGTTGGCCAAGTCAATTGCCAACTGCCAGGTGGAGCTTCTGGAAAACTGTGGGCACTC
AGTAGTGATGGAAAGACCCAGGAAGACAGCCAAGCTCATAATCGACTTTTTAGCTTCTGTGCACAACACA
GACAACAACAAGAAGCTGGACTGAGGCCCCGACTGCAGCCTGCATTCTGCACACAGCATCTGCTCCCATC
CCCCAAGTCTGACGCAGCCACCACTCTCAGGGATCCTGCCCCAAATGCGGTCGGAGCGCCAGTGACCCTG
AGGAAGCCCGTCCCTTATCCCTGGTATCCACGGTTCCCCAGAGCTTTGGGGACCACGCGAAAACCTCCAA
GATATTTTTCACAAAATAGAAACTCATATGGAACAAAATAAGAAACCCCAGCCATGAAATCTACCATGAA
GTCTTCAAGTTCATGTCACTGAGAAGCTTGTGCAAAGCAGCCACCTTGGACCATAATTAAATCAAGGACA
TTTTCTTTGAGACATTCCTTATAGTTGGAGACTCAAGATATTTTGTTGCATCAGGTGTATTCCCTTGCA
TGGGCAGTGGCTTTTATAGGAGCATTAGTCCTCATTCGCTGAACCCTGTTGTTTAGGTCTAATTTAAGTT
TTACATAGAGACCCATGTATGACTGCAGCCCATTGGCTGCAAGACCAGGGAGGAAAGTGGCAAGCTGTAG
AAAATGTTTACACGCATGGAGGGGCATTGCTCTAGCCCTCAGAGCGTCCGGAGCAGCAGGGTACATGGGT
GGGAGGTTCATTCAGCACCCACCAGTCAGGTATGTTCTGAGTGAACCCACAGCAGTCGCAGAATGAGCAC
CTGGCAGGGTGGGTTTCCTAGGAATAATTTATTATTTTTAAAAATAGGCCTAATAAAGCAATAATGTTCT
AGACATCTGTCTAAGTAATCAGACTCAGGTTCCACACACAAGCAACAACTCGTGGGCCTCTTTTCTATTT
CAATGTGCTACTAAGAACCCTTGGATGTAACATACTAGTTAGTTAATGAATTCTGTGAATTCTGTGAAGA
GTAATGTGATTGAAAATAAGTCTAAACAGCTGTAAAAGTGACCACAATGACATGAAATAAATTTAATAAG
TCTAGATCAGCAAAAAAAAAAAAAAAAAAAAAAA

>gi|56676320|ref|NM_022165.2| Homo sapiens lin-7 homolog B (C. elegans) (LIN7B),
mRNA
GCCGGCGCCAGGGCAGGCGGGCGGCTGGCAGCTGTGGCGCCGACATGGCTGCGCTGGTGGAGCCGCTGGG
GCTGGAGCGGGACGTGTCCCGGGCGGTTGAGCTCCTCGAGCGGCTCCAGCGCAGCGGGGAGCTGCCGCCG
CAGAAGCTGCAGGCCCTCCAGCGAGTTCTGCAGAGCCGCTTCTGCTCCGCTATCCGAGAGGTGTATGAGC
AGCTTTATGACACGCTGGACATCACCGGCAGCGCCGAGATCCGAGCCCATGCCACAGCCAAGGCCACAGT
GGCTGCCTTCACAGCCAGCGAGGGCCACGCACATCCCAGGGTAGTGGAGCTACCCAAGACGGATGAGGGC
CTAGGCTTCAACATCATGGGTGGCAAAGAGCAAAACTCGCCCATCTACATCTCCCGGGTCATCCCAGGGG
GTGTGGCTGACCGCCATGGAGGCCTCAAGCGTGGGGATCAACTGTTGTCGGTGAACGGTGTGAGCGTTGA
GGGTGAGCAGCATGAGAAGGCGGTGGAGCTGCTGAAGGCGGCCCAGGGCTCGGTGAAGCTGGTTGTCCGT
TACACACCGCGAGTGCTGGAGGAGATGGAGGCCCGGTTCGAGAAGATGCGCTCTGCCCGCCGGCGCCAAC
```

Figure 20 (Continued)

```
AGCATCAGAGCTACTCGTCCTTGGAGTCTCGAGGTTGAAACCACAGATCTGGACGTTCACGTGCACTCTC
TTCCTGTACAGTATTTATTGTTCCTGGCACTTTATTTAAAGATATTTGACCCTCA

>gi|307078131|ref|NM_022337.2| Homo sapiens RAB38, member RAS oncogene family
(RAB38), mRNA
TTGCGCTCCCCAAGTCTCTCTCGTGCGCAGAGCCCAGGCTGCGCTTCCCTGGTCAGGCACGGCACGTCTG
GCCGGCCGCCAGGATGCAGGCCCCGCACAAGGAGCACCTGTACAAGTTGCTGGTGATTGGCGACCTGGGC
GTGGGGAAGACCAGTATCATCAAGCGCTACGTGCACCAGAACTTCTCTTCGCACTACCGGGCCACAATCG
GCGTGGACTTCGCGCTCAAGGTGCTCCACTGGGACCCGGAGACTGTGGTGCGCCTGCAGCTCTGGGATAT
CGCAGGTCAAGAAAGATTTGGAAACATGACGAGGGTCTATTACCGAGAAGCTATGGGTGCATTTATTGTC
TTCGATGTCACCAGGCCAGCCACATTTGAAGCAGTGGCAAAGTGGAAAAATGATTTGGACTCCAAGTTAA
GTCTCCCTAATGGCAAACCGGTTTCAGTGGTTTTGTTGGCCAACAAATGTGACCAGGGGAAGGATGTGCT
CATGAACAATGGCCTCAAGATGGACCAGTTCTGCAAGGAGCACGGTTTCGTAGGATGGTTTGAAACATCA
GCAAAGGAAAATATAAACATTGATGAAGCCTCCAGATGCCTGGTGAAACACATACTTGCAAATGAGTGTG
ACCTAATGGAGTCTATTGAGCCGGACGTCGTGAAGCCCCATCTCACATCAACCAAGGTTGCCAGCTGCTC
TGGCTGTGCCAAATCCTAGTAGGCACCTTTGCTGGTGTCTGGTAGGAATGACCTCATTGTTCCACAAATT
GTGCCTCTATTTTTACCATTTTGGGTAAACGTCAGGATAGAGATACCACATGTGGCAAGCCAAAGATCTA
TGCCTCTGTTTTTTCAGTGAGAGAGAAATAGCAAATGTTCTTTCTATGCTTTCCTCACCATCATCACAGT
GTTTACAAACTTTTGAAAATATTTAGTCTGTTACAAACTTCTGTCATGTAGCTGACCAAAATCCTGCAGG
GCCACAGTCGGCACTGTTATTTGCTTCTTTTAATCAGCAAAGCCTCAAGTCTTAAAATAAAAGGGGAGA
AGAACAAACTAGCTGTCAAGTCAAGGACTGGCTTTCACCTTGCCCTGGTGTCTTTTTCCAGATTTCAGTA
TATTCTCTGATGGCCTGACAGGCCTATTAAGTAGATGTGATATTTTCTCCCAAGATGACCTCCATTCTCG
GCAGACCTAAGAGTTGCCTCTGAGTTAGCTCTTTGGAATCGTGAACACAGGTGTGCTATATTGTCCTTGT
CCTAACTGTCACTTGCCATGGCCTGAATGTTGGCTTAACTGAATATTGTATGAAAAGACATGCCTCCATA
TGTGCCTTTCTGTTAGCTTTCTCTGACTCAAGCTGTGGGCTCCTCTATACATGCTATACATGTAATATA
TATTATATATATTTTTGCAAGTGAACAATAAAACATTAAAAGATGCTGTTTCCCTATTTAAAAAAAAAAA
AAAAAAAAA >gi|118918416|ref|NM_022573.2| Homo sapiens testis specific protein, Y-linked 2
(TSPY2), mRNA
GGCTCTTCGCGCGCAGTCCCTTAGGGGCGCCTGGAAGCCCGGCGCATGCGCCCTGAGGGCTCGCTGACC
TACCGGGTGCCAGAGAGGCTGCGGCAGGGTTCCTGTGGCGTGGGTCGGGCAGCACAGGCCTTGGTGTGTG
CGAGTGCCAAGGAGGGCACCGCCTTCAGGATGGAGGCTGTGCAGGAGGGGCGGCCGGGGTGGAGAGTGA
GCAGGCGGCTTTGGGGGAGGAGGCGGTGCTGCTGTTGGATGACATAATGGCGGAGGTGGAGGTGGTGGCG
GAGGAGGAGGGCCTCGTGGAGCGGCGGGAGGAGGCCCAGCGGGCACAGCAGGCTGTGCCTGGCCCTGGGC
CCATGACCCCAGAGTCTGCACTGGAGGAGCTGCTGGCCGTTCAGGTGGAGCTGGAGCCGGTTAATGCCCA
AGCCAGGAAGGCCTTTTCTCGGCAGCGGGAAAAGATGGAGCGGAGGCGCAAGCCCCACCTAGACCGCAGA
GGCGCCGTCATCCAGAGCGTCCCTGGCTTCTGGGCCAATGTTATTGCAAACCACCCCCAGATGTCAGCCC
TGATCACTGACGAAGATGAAGACATGCTGAGCTACATGGTCAGCCTGGAGGTGGAAGAAGAGAAGCATCG
TGTTCATCTCTGCAAGATCATGTTGTTCTTTCGGAGTAACCCCTACTTCCAGAATAAAGTGATTACCAAG
GAATATCTGGTGAACATCACAGAATACAGGGCTTCTCATTCCACTCCAATTGAGTGGTATCCGGATTATG
AAGTGGAGGCCTATCGCCGCAGACACCACAACAGCAGCCTTAACTTCTTCAACTGGTTCTCTGACCACAA
```

Figure 20 (Continued)

CTTCGCAGGATCTAACAAGATTGCTGAGATCCTATGTAAGGACCTGTGGCGCAATCCCCTGCAATACTAC
AAGAGGATGAAGCCACCTGAAGAGGGAACAGAGACGTCAGGGGACTCCCAGTTGTTGAGTTGAATATGAT
GGAGCATCAGATTTTACCTAATACAGCAGAACTCCTAAAAAGTTACAGCCATATGCAGGACAGCAGTACT
CAGCATGGTCTTATGCACAGGAACTAAAGGAAAAAGAGATCGAGTCACAAAAATTCAGGAAGAGGGGGTA
AATGTGGATTGTATGGAATGAAAAATAAACATTCTCAAGG

>gi|197333804|ref|NM_022776.4| Homo sapiens oxysterol binding protein-like 11
(OSBPL11), mRNA
GCTGTGGGGCTGTGGGTGGGGCGGCGGCCGCGGCCCTGGCATTCGCGCTTGGGTCTGGAGATAGCGCGAG
AGACTCACCGGCTCCTGGGAACCCAGTCGAGGGCCCGGGCCAGGGGCATAAGAGGAAGTTGTCCCGAGTG
GCTCGCCTCTGGCCCTGGGAGAGGCGGCCCCGGGAGCCGGCGTCCCGCCCCGGCGGCCTCATTCCCCGA
CCCTCCTCCCCGGCTGCGCGCGCCGGCCCTGGCTGTATCTCGGGGGCTGCGGCGGGAACTGCCGAGCGGG
CTTGACTGGACGCACTGCCTGAGGACCTGCGGAGGAGACGAGGGAGCGCGGCGGGTCAGCCCCGAGGTTA
GGCCGCGGGTCCCCTGTCCGTGGCGCTCCGTCCTTTTCCCAGCCGTCTTGGCTACAGAATCTGCGACCTC
CCCACACTCCTTCTCTTTTGAGTATGTCACTTAAGTCTTCTCGCCGGATGCTTTTTCCTCCTTGCTTTTG
CCGGAAAGGAGAGAGATACATGTGAAGGATATCTGTCCTCGTTGCTTCCCCTGCCCTCTCAAAAGTTTAA
CTTCTGTGGGAATGTGTATCTTCCTTTTCTGGACCATTTGACAGTCCCGCCCCAGCCGCCGTGTGATTTA
GCAACCGGTATCATATTCAGATCAAATCTTAAAAAAAAAAAGTCACCTACAGAACTACAGAATTGTTCTC
TCCCGCTCAAGAAGGGCAAGTGGACTTTGGCGTTAAGATGCAGGGGGTGAACCAGTGTCCACAATGAAA
GTCTCGGAGAGCGAAGGAAAGCTGGAGGGCCAGGCCACAGCGGTGACCCCGAACAAGAACAGCAGCTGTG
GAGGTGGAATCAGTAGCAGCAGCAGCAGCCGCGGTGGCAGTGCAAAAGGCTGGCAGTACAGTGATCACAT
GGAAAATGTGTATGGCTATTTAATGAAGTATACCAACCTTGTCACTGGGTGGCAGTACAGGTTTTTTGTT
TTAAACAATGAAGCTGGGCTGTTGGAGTACTTTGTGAATGAACAGTCTAGAAATCAGAAACCTAGAGGAA
CTTTGCAGCTTGCAGGAGCTGTAATATCACCCAGTGATGAGGATTCTCACACCTTCACTGTAAACGCTGC
CAGTGGGGAACAATATAAACTCAGAGCTACAGATGCAAAAGAGCGACAGCACTGGGTTAGCAGACTTCAG
ATATGTACACAGCATCATACTGAAGCTATTGGAAAGAATAATCCTCCTCTGAAGTCACGGAGCTTCTCAC
TTGCATCTAGTAGTAATTCTCCTATATCGCAGAGGAGACCAAGTCAAAATGCCATTTCTTTTTTTAATGT
TGGACATTCCAAACTGCAATCACTGAGCAAAAGAACTAATTTACCTCCAGACCATCTTGTGGAAGTCAGA
GAAATGATGTCTCATGCTGAAGGACAACAAAGAGACTTAATTAGACGAATTGAATGCCTTCCTACTTCTG
GCCATCTTAGTTCCTTGGACCAGGATCTCTTAATGCTCAAAGCTACTTCCATGGCAACTATGAACTGCTT
AAATGACTGCTTTCATATTCTCCAGTTACAGCATGCATCACATCAGAAGGGCTCATTGCCTTCAGGAACG
ACAATCGAGTGGTTAGAACCAAAGATATCTTTATCAAACCACTATAAAAATGGAGCTGACCAGCCCTTTG
CAACTGATCAGAGTAAGCCGGTGGCAGTCCCAGAAGAGCAGCCTGTTGCAGAATCTGGACTATTAGCGAG
GGAGCCTGAAGAAATAAATGCAGATGATGAGATAGAGGATACATGTGACCACAAAGAGGATGACCTGGGA
GCTGTAGAAGAACAACGTAGTGTCATCCTACATCTCTTGTCACAGCTTAAGCTGGGCATGGATTTAACAA
GAGTGGTGCTTCCTACATTTATCCTAGAGAAGCGTTCCTTGCTGGAAATGTATGCAGACTTTATGTCTCA
TCCAGACCTATTTATAGCCATCACTAATGGAGCCACAGCTGAGGACAGAATGATTCGCTTTGTTGAGTAC
TACCTTACCTCATTTCATGAAGGCCGTAAGGGAGCCATTGCTAAAAAACCATACAATCCTATCATTGGAG
AAACATTTCACTGTTCCTGGAAGATGCCAAAAAGCGAGGTAGCATCCAGTGTTTTTAGCAGTTCTTCCAC
CCAGGGAGTCACAAATCATGCTCCTTTATCGGGGGAGTCTTTGACCCAGGTGGGATCAGACTGTTACACA
GTCAGATTTGTTGCTGAGCAGGTTTCTCATCATCCTCCAGTCTCAGGATTTATGCAGAATGTACAGAGA
GGAAGATGTGTGTAAATGCGCATGTCTGGACTAAGAGCAAGTTCTTAGGCATGTCAATAGGCGTGACAAT

Figure 20 (Continued)

```
GGTTGGAGAAGGTATCCTTAGTCTGTTGGAGCATGGAGAAGAGTACACATTTTCTCTACCCTGTGCATAT
GCTCGGTCAATTTTGACTGTTCCTTGGGTAGAACTGGGTGGCAAAGTCAGTGTCAACTGTGCAAAAACTG
GATATTCAGCCAGCATCACTTTTCATACCAAGCCATTTTATGGTGGCAAACTGCATCGGTTACAGCTGA
AGTAAAGCACAACATCACCAACACTGTGGTATGCAGAGTGCAAGGGGAATGGAATAGTGTTCTTGAGTTC
ACATATAGCAATGGAGAGACAAAGTATGTGGACTTGACTAAATTGGCAGTGACGAAGAAAAGAGTGAGAC
CTCTGGAGAAGCAGGATCCATTTGAATCCAGGCGATTGTGGAAAAATGTGACAGACTCGCTGAGAGAATC
TGAAATTGATAAGGCCACAGAGCATAAGCATACCCTGGAAGAACGTCAGAGGACTGAAGAAAGGCATCGT
ACTGAAACAGGCACACCTTGGAAAACCAAATATTTTATTAAAGAGGGAGATGGCTGGGTTTATCATAAAC
CACTTTGGAAAATAATTCCAACAACACAACCAGCAGAGTGACACATACTATCTAAAACTCGACCAAATGA
GGTTCTTCTCTGTTTACCCTAAATCCTCCCAGAATGGAGTCATTGCACTGAGTGACCTGCTTCCTGATTG
CGCAGACTGAAACTAGCTAAACCTGAATGTACCTACTAGGGCACCATAATACTGCAGCAAGACCAAAGTG
GTAAAGAAACACAGTGGACCTTTTACCAACCTGTTCATGTGATGTGAGCAATACCATCTTAAAACTTGTT
ACCTGAATCAGTAGATGAATCTTTTATCCAGTTCTTGCTCCTAAAGTTAAGTTTGAATCCCCTATTTTTG
CACAGGGGCAGCAGATACACACAACAATGAGAACTCAGTGACTTTGATTTCTTTGTAGTGAAAAGTGAAG
TCTCCGTTTCAGAGTTTGTGTCTTTCTTTCTGTCCATAACTGAAGTATTCACTACTCTTGTAAACCAACC
AAGAGGAGGAGAAAGATGACCCAGAAGTGGATTCAGCCATTGTGCCTGAAATCAGTGTTTAAAAAAAAAA
ATCAACCAGGTTGTGGTAACAAGGCATTCTATTTCTTCAAAAAGACTGTATGCCTGTGTCTGAGGAACTT
ACCTATTATCCACCTCTGTTGGAACTCTCTTTTAAAAAGTACATTTATAGATTGATCAGAATTATAACCA
TGGAGAATTTTTTCTTCTGAGCATTTTAATATACTTGAAAACAACATTGACTTGAAAAATTTCAGAACAT
TTTTCAGTACCTAGTTTTATTAAATATTACACTTGAGAGACACTTTTTAAAAATGTGTTAATGTCAATAT
GATGAGATTTTAGCCTTTCTCCAGAACTAAGGCATTAAAGAAAATAGCAAATATTAAAAAATAAAACTGT
TACTTTTTTCCTTCTTTCTTTTCACCTTTAGGTTAATATCCAGTATTATGTGTTATCCCTTTGGATAAGT
ATGCTTTATTTTACCTCTGTTAAAAATTAAAATAAATGATTCTATTCATATTTGTCAGTAATTCAAAACT
TATATGTGTAACTGAACGCGCATGTAAGGTATGGTTTTATTTATTTTTTTTTTTTGAGGAAATTTAAA
TGCTAAAGAAACAACGAAATGAAAAGGTATCAGGAAAAAAAGATCAGGAAGTTGTATTCAGGTACAAATC
TTTTTTTAAATAAGTATTTTGTTGAGGTTGAAGAATTGCTGGCAATTAAAAGAATAGAGCTAATTATGGC
TTTCATCATTCATTCATGTATTTATTGAGCACCTACTTATTATGGTGCTCAACACTTGTTACTGCAAGCT
ACCTTAATTTCCCAAGAGTGGTGCCTTACTCTGTTTTTTCTGATATGGTCTTCCAATCAGTGTGTGTAAC
ATACCTGTTGTTTATCAGCCATTGTAGGTGGCTGTGTCTGTTGCATCATCATAAGAAGTTTAAGCTTTGT
GCTCTGATAAATTGTGTTCTGTTAAAGAGGTTAGTAGGATGAAAACAGCAAAACAATAATTTTTTCAACA
AATTGTAAATTATAAGAAAAAGAGTTGGTTTGTGTACAACAATTTTAATGATTCCCTTGTTCATTTTTGC
TGTGAAATGCACTGAAAAAAATCCTCAAAATGAGTTATAGTTCCTGTGTTGGGAAAATTGACAAATAATA
AAACTAGAGAACAAACAAAAAAAAAAAAAAA
```

```
>gi|302191680|ref|NM_023079.4| Homo sapiens ubiquitin-conjugating enzyme E2Z
(UBE2Z), mRNA
AGCACCGTCTGGGCTGTGGAAGCGGAGGGGGTGGGACACTCTGGCCCGGTTCTCGGTGGTGCGGGAGCG
GGCGGGAGCAGCGGCCGCTCTGGTCGGCGGACGTGCTGCCGAGTAGTCCCGGAAGCGAAGCAGCGATGGC
GGAGAGTCCGACTGAGGAGCGGCAACGGCGGGCGCCGGGCGGCGGGCCCGGGGCGAGCAGCGTTGCT
GGTGTTGTTGGCGTTAGCGGCAGCGGCGGCGGGTTCGGGCCGCCTTTCCTGCCGGATGTGTGGGCGGCGG
CGGCGGCAGCGGGCGGGCCGGGGCCCGGGGAGCGGCCTGGCTCCGCTGCCCGGGCTCCCGCCCTCAGC
CGCTGCCCACGGGGCCGCGCTGCTTAGCCACTGGGACCCCACGCTCAGCTCCGACTGGGACGGCGAGCGC
```

Figure 20 (Continued)

```
ACCGCGCCGCAGTGTCTACTCCGGATCAAGCGGGATATCATGTCCATTTATAAGGAGCCTCCTCCAGGAA
TGTTCGTTGTACCTGATACTGTTGACATGACTAAGATTCATGCATTGATCACAGGCCCATTTGACACTCC
TTATGAAGGGGGTTTCTTCCTGTTCGTGTTTCGGTGTCCGCCCGACTATCCCATCCACCCACCTCGGGTC
AAACTGATGACAACGGGCAATAACACAGTGAGGTTTAACCCCAACTTCTACCGCAATGGGAAAGTCTGCT
TGAGTATTCTAGGTACATGGACTGGACCTGCCTGGAGCCCAGCCCAGAGCATCTCCTCAGTGCTCATCTC
TATCCAGTCCCTGATGACTGAGAACCCCTATCACAATGAGCCCGGCTTTGAACAGGAGAGACATCCAGGA
GACAGCAAAAACTATAATGAATGTATCCGGCACGAGACCATCAGAGTTGCAGTCTGTGACATGATGGAAG
GAAAGTGTCCCTGTCCTGAACCCCTACGAGGGGTGATGGAGAAGTCCTTTCTGGAGTATTACGACTTCTA
CGAGGTGGCCTGCAAAGATCGCCTGCACCTTCAAGGCCAAACTATGCAGGACCCTTTTGGAGAGAAGCGG
GGCCACTTTGACTACCAGTCCCTCTTGATGCGCCTGGGACTGATACGTCAGAAAGTGCTGGAGAGGCTCC
ATAATGAGAATGCAGAAATGGACTCTGATAGCAGTTCATCTGGGACAGAGACAGACCTTCATGGGAGCCT
GAGGGTTTAGACCCTGCTCCCATCTCCCCTTCCCCCACTCAAGAGTCCCAGCAGAATCCCTTCCCCCCAC
CCCAGGGATGGAGAGGCACTGTGTATCTCCCTCCAGACTCGAAGTCATCCTGCAAGATGGCAAGAACCAA
GCAAGCTCCGATCCCAGGGTGTGGGAGTGGGGGCCTGTTCCCGGTCTGACCTCCTTGGCACTGGAGCATC
TGGGGCTTCGTTCATCCATTCATCCCGTATCAGGGGCCAAGGTACCTTTACAGGAGCACCTAGAGCGAGG
GCCTTTGGCAAAAACAAAACAACCAACACACCTCTCCACAGGGCCAGCTCCTTAGGGATAAGTGGAAGAT
GGAAATTGCAATTCCAAGAGGGAGTGTGCCCAAATGATTTATGGGGATACCTGGAAGGGAGCTTGGGGTG
GGGGCTGTCTGTGACACTTAAGCAGTCTGGGTGGTTGTCTATTTGTCTGTCTTCAGTCTTGAAGCAGGGC
TTCCCAATGCCCTTTTCCTCCCTGCCTTCCTTCCCCCATTATTTCCCACAGGCCAGCATAATTTTGTTTT
TCCTAATTTATAGTCACTGTTCTAGACAGACCAAAGAGAAGGAACAGTGGTGGAGTCTAGGCTGCTGATC
AGTAAGCTTTACCTAGCACCTGAGCACCTTTCTCCCCTCCCCTCTTTCCTCACCCTTTTCTAGATGTAAG
ACAGAAAGTAAATGTGACTGGGACTTAACCAAGGTCTTGGTAAAGCCTGCATGGCACCGTAAGAAGCTGA
AAATACTGTTTGTTCCCGCAATCACTGATTTGAAAAGTTCCCAACACAGGCAGCTGCTGTGTATATGGGA
TTAGAGCCACTACATAGAATAGTCTCTTACAGATTTTCATAAATACTAGTCACAATAAGGGTATTTTTCT
TGGGGGTGGAGTAAGGGGGAGACTGATGCTAGTCCTTGTTGTATTTTGTTGGGCTGTCCTTGTGTATTTT
CACCCCAGCCTGTAGTCCTCCTCACTTCAACCCCAGGGATTTTTGGGGAGCAAGGGTAGCCAATGGCAGA
GGGGGTTGGGGCTGGGACTCTGGAGGCTCCTCCCCTTCTTTCTCTTCCTTCCGCCTCCCCCGTGCCCCCA
GCTGCTCTTGTCACTGTCTCTGATGGGTATTTGCCTGGCTTTGTTGCTTCTCTATCTGTATTTAGCTGCA
GTGATCCTTTAGCTGGTTGGCTCAGAAAAAAAAAAAATGTGCTTTAGGTGCCCTGTAATCCTGGGCATCAA
GGGAATCCATCCTTCCCCTTTTTGATATGTTCTCCCCGTACTTCCAGATTTATTGTTATGGCTCCCAGTG
GGTATTGGCGATTCTTGTGATGCAGGGCCTCAGTCAGTGTCCAGCCATGCATAAGGGAGAGGATAGTGTG
TACCTGCCCTGCCCTCTGCTATGAAGGTCTCTGCCTTGTGGATCATGGGACTCCCCTTGGAGGATCTGTG
CAAAGGGGGCTGGGCACAAAGGAGAATGTCCTATTTGGGAGGGCAGGAAGCAAAGGAACTGGACAGGGA
TTGGTGGGCTTGGGGAACGGAAGTTTATCTTGGATACCCTTGAAGAGGCTGGGTCTCTTCACATGAAGAT
CGAAAAGGGACCCTGCTTCCAATTTCCCTCTTCCATTCCTCGAGCTACTCCAGGGCTTAGAAGAATGCTC
TTGGTCTGTGGGTCCAGTGTTGTCTGTCATCCATTTAAGTGTTCCCACTTTCAAGTGACAATCCTCTCCT
TGGCCCTGCCATAGGGCAGAGCATGTCTGGCATAGCAGCCTGACTTTTATGCCCTAATCTTGAGTTGAGG
AAATATATGCACAGGAGTCAAAGAGATGTCTTTATATCTGACTGTATATAAATGAAGTTTTTTGTTTTT
TTTGTTTTCCTTTTTGGTGCAATAAAGTTTGTTTTGGCAGAAGGAGAAAAAAAAAAA

>gi|296010928|ref|NM_024312.4| Homo sapiens N-acetylglucosamine-1-phosphate
transferase, alpha and beta subunits (GNPTAB), mRNA
```

Figure 20 (Continued)

```
GCTCCCGGAAGCGGCGGCCGCGGCGCGGAGCCGAGCGGGCGTCCGTCGCCGGAGCTGCAATGAGCGGCGC
CCGGAGGCTGTGACCTGCGCGCGGCGGCCCGACCGGGGCCCCTGAATGGCGGCTCGCTGAGGCGGCGGCG
GCGGCGGCGGCGGCTCAGGCTCCTCGGGGCGTGGCGTGGCGGTGAAGGGGTGATGCTGTTCAAGCTCCTG
CAGAGACAGACCTATACCTGCCTGTCCCACAGGTATGGGCTCTACGTGTGCTTCTTGGGCGTCGTTGTCA
CCATCGTCTCCGCCTTCCAGTTCGGAGAGGTGGTTCTGGAATGGAGCCGAGATCAATACCATGTTTTGTT
TGATTCCTATAGAGACAATATTGCTGGAAAGTCCTTTCAGAATCGGCTTTGTCTGCCCATGCCGATTGAC
GTTGTTTACACCTGGGTGAATGGCACAGATCTTGAACTACTGAAGGAACTACAGCAGGTCAGAGAACAGA
TGGAGGAGGAGCAGAAAGCAATGAGAGAAATCCTTGGGAAAAACACAACGGAACCTACTAAGAAGAGTGA
GAAGCAGTTAGAGTGTTTGCTAACACACTGCATTAAGGTGCCAATGCTTGTCCTGGACCCAGCCCTGCCA
GCCAACATCACCCTGAAGGACCTGCCATCTCTTTATCCTTCTTTTCATTCTGCCAGTGACATTTTCAATG
TTGCAAAACCAAAAAACCCTTCTACCAATGTCTCAGTTGTTGTTTTTGACAGTACTAAGGATGTTGAAGA
TGCCCACTCTGGACTGCTTAAAGGAAATAGCAGACAGACAGTATGGAGGGGCTACTTGACAACAGATAAA
GAAGTCCCTGGATTAGTGCTAATGCAAGATTTGGCTTTCCTGAGTGGATTTCCACCAACATTCAAGGAAA
CAAATCAACTAAAAACAAAATTGCCAGAAAATCTTTCCTCTAAAGTCAAACTGTTGCAGTTGTATTCAGA
GGCCAGTGTAGCGCTTCTAAAACTGAATAACCCCAAGGATTTTCAAGAATTGAATAAGCAAACTAAGAAG
AACATGACCATTGATGGAAAAGAACTGACCATAAGTCCTGCATATTTATTATGGGATCTGAGCGCCATCA
GCCAGTCTAAGCAGGATGAAGACATCTCTGCCAGTCGTTTTGAAGATAACGAAGAACTGAGGTACTCATT
GCGATCTATCGAGAGGCATGCACCATGGGTTCGGAATATTTTCATTGTCACCAACGGGCAGATTCCATCC
TGGCTGAACCTTGACAATCCTCGAGTGACAATAGTAACACACCAGGATGTTTTTCGAAATTTGAGCCACT
TGCCTACCTTTAGTTCACCTGCTATTGAAAGTCACATTCATCGCATCGAAGGGCTGTCCCAGAAGTTTAT
TTACCTAAATGATGATGTCATGTTTGGGAAGGATGTCTGGCCAGATGATTTTTACAGTCACTCCAAAGGC
CAGAAGGTTTATTTGACATGGCCTGTGCCAAACTGTGCCGAGGGCTGCCCAGGTTCCTGGATTAAGGATG
GCTATTGTGACAAGGCTTGTAATAATTCAGCCTGCGATTGGGATGGTGGGGATTGCTCTGGAAACAGTGG
AGGGAGTCGCTATATTGCAGGAGGTGGAGGTACTGGGAGTATTGGAGTTGGACAGCCCTGGCAGTTTGGT
GGAGGAATAAACAGTGTCTCTTACTGTAATCAGGGATGTGCGAATTCCTGGCTCGCTGATAAGTTCTGTG
ACCAAGCATGCAATGTCTTGTCCTGTGGGTTTGATGCTGGCGACTGTGGCAAGATCATTTTCATGAATT
GTATAAAGTGATCCTTCTCCCAAACCAGACTCACTATATTATTCCAAAAGGTGAATGCCTGCCTTATTTC
AGCTTTGCAGAAGTAGCCAAAAGAGGAGTTGAAGGTGCCTATAGTGACAATCCAATAATTCGACATGCTT
CTATTGCCAACAAGTGGAAAACCATCCACCTCATAATGCACAGTGGAATGAATGCCACCACAATACATTT
TAATCTCACGTTTCAAAATACAAACGATGAAGAGTTCAAAATGCAGATAACAGTGGAGGTGGACACAAGG
GAGGGACCAAAACTGAATTCTACAGCCCAGAAGGGTTACGAAAATTTAGTTAGTCCCATAACACTTCTTC
CAGAGGCGGAAATCCTTTTTGAGGATATTCCCAAAGAAAAACGCTTCCCGAAGTTTAAGAGACATGATGT
TAACTCAACAAGGAGAGCCCAGGAAGAGGTGAAAATTCCCCTGGTAAATATTTCACTCCTTCCAAAAGAC
GCCCAGTTGAGTCTCAATACCTTGGATTTGCAACTGGAACATGAGACATCACTTTGAAAGGATACAATT
TGTCCAAGTCAGCCTTGCTGAGATCATTTCTGATGAACTCACAGCATGCTAAAATAAAAAATCAAGCTAT
AATAACAGATGAAACAAATGACAGTTTGGTGGCTCCACAGGAAAAACAGGTTCATAAAAGCATCTTGCCA
AACAGCTTAGGAGTGTCTGAAAGATTGCAGAGGTTGACTTTTCCTGCAGTGAGTGTAAAAGTGAATGGTC
ATGACCAGGGTCAGAATCCACCCCTGGACTTGGAGACCACAGCAAGATTTAGAGTGGAAACTCACACCCA
AAAACCATAGGCGGAAATGTGACAAAAGAAAAGCCCCCATCTCTGATTGTTCCACTGGAAAGCCAGATG
ACAAAAGAAAAGAAAATCACAGGGAAAGAAAAAGAGAACAGTAGAATGGAGGAAAATGCTGAAAATCACA
TAGGCGTTACTGAAGTGTTACTTGGAAGAAAGCTGCAGCATTACACAGATAGTTACTTGGGCTTTTTGCC
ATGGGAGAAAAAAAAGTATTTCCAAGATCTTCTCGACGAAGAAGAGTCATTGAAGACACAATTGGCATAC
```

Figure 20 (Continued)

```
TTCACTGATAGCAAAAATACTGGGAGGCAACTAAAAGATACATTTGCAGATTCCCTCAGATATGTAAATA
AAATTCTAAATAGCAAGTTTGGATTCACATCGCGGAAAGTCCCTGCTCACATGCCTCACATGATTGACCG
GATTGTTATGCAAGAACTGCAAGATATGTTCCCTGAAGAATTTGACAAGACGTCATTTCACAAAGTGCGC
CATTCTGAGGATATGCAGTTTGCCTTCTCTTATTTTTATTATCTCATGAGTGCAGTGCAGCCACTGAATA
TATCTCAAGTCTTTGATGAAGTTGATACAGATCAATCTGGTGTCTTGTCTGACAGAGAAATCCGAACACT
GGCTACCAGAATTCACGAACTGCCGTTAAGTTTGCAGGATTTGACAGGTCTGGAACACATGCTAATAAAT
TGCTCAAAAATGCTTCCTGCTGATATCACGCAGCTAAATAATATTCCACCAACTCAGGAATCCTACTATG
ATCCCAACCTGCCACCGGTCACTAAAAGTCTAGTAACAAACTGTAAACCAGTAACTGACAAAATCCACAA
AGCATATAAGGACAAAAACAAATATAGGTTTGAAATCATGGGAGAAGAAGAAATCGCTTTTAAAATGATT
CGTACCAACGTTTCTCATGTGGTTGGCCAGTTGGATGACATAAGAAAAAACCCTAGGAAGTTTGTTTGCC
TGAATGACAACATTGACCACAATCATAAAGATGCTCAGACAGTGAAGGCTGTTCTCAGGGACTTCTATGA
ATCCATGTTCCCCATACCTTCCCAATTTGAACTGCCAAGAGAGTATCGAAACCGTTTCCTTCATATGCAT
GAGCTGCAGGAATGGAGGGCTTATCGAGACAAATTGAAGTTTTGGACCCATTGTGTACTAGCAACATTGA
TTATGTTTACTATATTCTCATTTTTTGCTGAGCAGTTAATTGCACTTAAGCGGAAGATATTTCCCAGAAG
GAGGATACACAAAGAAGCTAGTCCCAATCGAATCAGAGTATAGAAGATCTTCATTTGAAAACCATCTACC
TCAGCATTTACTGAGCATTTTAAAACTCAGCTTCACAGAGATGTCTTTGTGATGTGATGCTTAGCAGTTT
GGCCCGAAGAAGGAAAATATCCAGTACCATGCTGTTTTGTGGCATGAATATAGCCCACTGACCAGGAATT
ATTTAACCAACCCACTGAAAACTTGTGTGTTGAGCAGCTCTGAACTGATTTTACTTTTAAAGAATTTGCT
CATGGACCTGTCATCCTTTTTATAAAAAGGCTCACTGACAAGAGACAGCTGTTAATTTCCCACAGCAATC
ATTGCAGACTAACTTTATTAGGAGAAGCCTATGCCAGCTGGGAGTGATTGCTAAGAGGCTCCAGTCTTTG
CATTCCAAAGCCTTTTGCTAAAGTTTTGCACTTTTTTTTTTCATTTCCCATTTTTAAGTAGTTACTAAG
TTAACTAGTTATTCTTGCTTCTGAGTATAACGAATTGGGATGTCTAAACCTATTTTTATAGATGTTATTT
AAATAATGCAGCAATATCACCTCTTATTGACAATACCTAAATTATGAGTTTTATTAATATTTAAGACTGT
AAATGGTCTTAAACCACTAACTACTGAAGAGCTCAATGATTGACATCTGAAATGCTTTGTAATTATTGAC
TTCAGCCCCTAAGAATGCTATGATTTCACGTGCAGGTCTAATTTCAAAGGGCTAGAGTTAGTACTACTTA
CCAGATGTAATTATGTTTTGGAAATGTACATATTCAAACAGAAGTGCCTCATTTTAGAAATGAGTAGTGC
TGATGGCACTGGCACATTACAGTGGTGTCTTGTTTAATACTCATTGGTATATTCCAGTAGCTATCTCTCT
CAGTTGGTTTTTGATAGAACAGAGGCCAGCAAACTTTCTTTGTAAAAGGCTGGTTAGTAAATTATTGCAG
GCCACCTGTGTCTTTGTCATACATTCTTCTTGCTGTTGTTTAGTTTGTTTTTTTTCAAACAACCCTCTAA
AAATGTAAAAACCATGTTTAGCTTGCAGCTGTACAAAAACTGCCCACCAGCCAGATGTGACCCTCAGGCC
ATCATTTGCCAATCACTGAGAATTAGTTTTTGTTGTTGTTGTTGTTGTTTTTGAGACAGAGTCTCTC
TCTGTTGCCCAGGCTGGAGTGCAGTGGCGCAATCTCAGCTCACTGCAACCTCCGCCTCCCGGGTTCAAGC
AGTTCTGTCTCAGCCTTCTGAGTAGCTGGGACTACAGGTGCATGCCACCACACCCTGCTAATTTTTGTAT
TTTTAGTAGAGACGGGGGTTCCACCATATTGGTCAGGCTTATCTTGAACTCCTGACCTCAGGTGATCCAC
CTGCCTCTGCCTCCCAAAGTGCTGAGATTACAGGCATAAGCCAGTGCACCCAGCCGAGAATTAGTATTTT
TATGTATGGTTAAACCTTGGCGTCTAGCCATATTTTATGTCATAATACAATGGATTTGTGAAGAGCAGAT
TCCATGAGTAACTCTGACAGGTATTTTAGATCATGATCTCAACAATATTCTTCCAAAATGGCATACATCT
TTTGTACAAAGAACTTGAAATGTAAATACTGTGTTTGTGCTGTAAGAGTTGTGTATTTCAAAAACTGAAA
TCTCATAAAAGTTAAATTTTTGTCTGACAAAAAAAAAAAAAAA

>gi|291219925|ref|NM_024718.4| Homo sapiens chromosome 9 open reading frame 86
(C9orf86), transcript variant 1, mRNA
```

Figure 20 (Continued)

```
CCTCCCGTCCCGCCGAGCCGGCGCCAAGATGGCGGCGCTGACTCCTGGAGAGCGGTCGCGCCGGAGGCCG
CGGGGGCCGGAGCGGAGCAGCCGCGGCTGAGGTTCCCGAGTCGCCGCTCGGGGCTGCGCTCCGCCGCCGG
GACCCCGGCCTCTGGCCGCGCCGGCTCCGGCCTCCGGGGGGCCGGGGCCGCCGGGACATGGTGCCAGTC
GCACCCCTTCCCCGCCGCCGCTGAGCTCGCCGGCCGCGCCCGGGCTGGGACGTCCGAGCGGGAAGATGTT
TTCCGCCCTGAAGAAGCTGGTGGGGTCGGACCAGGCCCCGGGCCGGGACAAGAACATCCCCGCCGGGCTG
CAGTCCATGAACCAGGCGTTGCAGAGGCGCTTCGCCAAGGGGTGCAGTACAACATGAAGATAGTGATCC
GGGGAGACAGGAACACGGGCAAGACAGCGCTGTGGCACCGCCTGCAGGGCCGGCCGTTCGTGGAGGAGTA
CATCCCCACACAGGAGATCCAGGTCACCAGCATCCACTGGAGCTACAAGACCACGGATGACATCGTGAAG
GTTGAAGTCTGGGATGTAGTAGACAAAGGAAAATGCAAAAAGCGAGGCGACGGCTTAAAGATGGAGAACG
ACCCCCAGGAGGCGGAGTCTGAAATGGCCCTGGATGCTGAGTTCCTGGACGTGTACAAGAACTGCAACGG
GGTGGTCATGATGTTCGACATTACCAAGCAGTGGACCTTCAATTACATTCTCCGGGAGCTTCCAAAAGTG
CCCACCCACGTGCCAGTGTGCGTGCTGGGAAACTACCGGGACATGGGCGAGCACCGAGTCATCCTGCCGG
ACGACGTGCGTGACTTCATCGACAACCTGGACAGACCTCCAGGTTCCTCCTACTTCCGCTATGCTGAGTC
TTCCATGAAGAACAGCTTCGGCCTAAAGTACCTTCATAAGTTCTTCAATATCCCATTTTTGCAGCTTCAG
AGGGAGACGCTGTTGCGGCAGCTGGAGACGAACCAGCTGGACATGGACGCCACGCTGGAGGAGCTGTCGG
TGCAGCAGGAGACGGAGGACCAGAACTACGGCATCTTCCTGGAGATGATGGAGGCTCGCAGCCGTGGCCA
TGCGTCCCCACTGGCGGCCAACGGGCAGAGCCCATCCCCGGGCTCCCAGTCACCAGTGGTGCCTGCAGGC
GCTGTGTCCACGGGGAGCTCCAGCCCCGGCACACCCCAGCCCGCCCCACAGCTGCCCCTCAATGCCGCCC
CACCATCCTCTGTGCCCCCTGTACCACCCTCAGAGGCCCTGCCCCCACCTGCGTGCCCCTCAGCCCCCGC
CCCACGGCGCAGCATCATCTCTAGGCTGTTTGGGACGTCACCTGCCACCGAGGCAGCCCCTCCACCTCCA
GAGCCAGTCCCGGCCGCAGAGGGCCCAGCAACGGTCCAGAGTGTGGAGGACTTTGTTCCTGACGACCGCC
TGGACCGCAGCTTCCTGGAAGACACAACCCCCGCCAGGGACGAGAAGAAGGTGGGGGCCAAGGCTGCCCA
GCAGGACAGCGACAGTGATGGGGAGGCCCTGGGCGGCAACCCGATGGTGGCAGGGTTCCAGGACGATGTG
GACCTCGAAGACCAGCCACGTGGGAGTCCCCCGCTGCCTGCAGGCCCCGTCCCCAGTCAAGACATCACTC
TTTCGAGTGAGGAGGAAGCAGAAGTGGCAGCTCCCACAAAAGGCCCTGCCCCAGCTCCCAGCAGTGCTC
AGAGCCAGAGACCAAGTGGTCCTCCATACCAGCTTCGAAGCCACGGAGGGGGACAGCTCCCACGAGGACC
GCAGCACCCCCTGGCCAGGCGGTGTCTCTGTTCGCACAGGTCCGGAGAAGCGCAGCAGCACCAGGCCCC
CTGCTGAGATGGAGCCGGGGAAGGGTGAGCAGGCCTCCTCGTCGGAGAGTGACCCCGAGGGACCCATTGC
TGCACAAATGCTGTCCTTCGTCATGGATGACCCCGACTTTGAGAGCGAGGGATCAGACACACAGCGCAGG
GCGGATGACTTTCCCGTGCGAGATGACCCCTCCGATGTGACTGACGAGGATGAGGGCCCTGCCGAGCCGC
CCCCACCCCCCAAGCTCCCTCTCCCCGCCTTCAGACTGAAGAATGACTCGGACCTCTTCGGGCTGGGGCT
GGAGGAGGCCGGACCCAAGGAGAGCAGTGAGGAAGGTAAGGAGGGCAAAACCCCCTCTAAGGAGAAGAAG
AAGAAGAAGAAAAAAGGCAAAGAGGAAGAAGAAAAAGCTGCCAAGAAGAAGAGCAAACACAAGAAGAGCA
AGGACAAGGAGGAGGGCAAGGAGGAGCGGCGACGGCGGCAGCAGCGGCCCCCGCGCAGCAGGGAGAGGAC
GGCTGCCGATGAGCTGGAGGCTTTCCTGGGGGGCGGGCCCCGGGCGGCCGCCACCCTGGGGGTGGCGAC
TACGAGGAGCTCTAGGCCGGCGTGGGCAGTGGCCGCCCTGGGCGGGGGCGTGCCTGTCACTGCCTGGG
GAGGCATTTGCCTCTGTACCATCGCCTTTGCCGCTGCCCCGTGGCTGCCGTGTGCGCTTCTGAGCTGGAA
GAGGCCGGGCATTGGTGGTCCCCAGGCTGGGCCTGCAGGTGCTGGGCCTTCAGGCCCAGTGTGAGCCTG
CTCTGCAAGAAGGGAGGGACAGCTGGCTTCAGCCAGGCTCGGTGGACACCCTGGCCCTCTCGGGGCAGA
GCCGCCAGTGTTTCTCAGGGATGTGACTGAGGCCCAGGAGGGACCTGTGAGGGTCTGTTTACAGAGGCTG
GGCAGGGGCCGCTTGGCTGTGGGGTGTGCGCTGCCCCGGCACCTGCTTGCCCTCCGCGCTCATCTGGGGC
CGCAGCATGCCTATGGTTCCGCTTCCGGCCGGGAGCCCTGAACACGGGTGTGCAGACTCACCCTAAAGGG
```

Figure 20 (Continued)

CGGCCCAGGCCCCACGCTAGAAGGCTGGCGAGACCGAAGGCAGCATGTGAGGCCTCTCCTGGGAGTGGGG
GTTGTGTTTCCCACAGTGGCCTCAGCTGCGCCCCGCTCAGGTGAGCCCGAAGGCAGGAGCCGGGAGGCA
CTCCTCCCAAACACTCCACTCAGACCATAAAGCACTCCTGTTTCACTCTGAAAAAAAAAAAAAAAAAA

>gi|225637559|ref|NM_024800.4| Homo sapiens NIMA (never in mitosis gene a)-
related kinase 11 (NEK11), transcript variant 1, mRNA
AGTATGCCCCGCGCCGTCTCCCTGGCCACGGTTCCAAACAGCCGTGGCCCGCGGTGTCTGGCGCTCGGTG
GGTGTGGTTGCCCCTAGTTTGAGGCCTGCCCGATTACCCGCAAGACTTGGGCAGCCCCGGGCGCCGCTCC
GACCACGACAGGGAAAGGAACCTTAATCTCATCTTTAAAATAAGGAGAATTACTGAGTGACCTGAAGGAC
CCTTTTCAGCTGGAAAGTCTGAACTGACCAACACTGGATGAATTTGACCATTTCTTAGGAGACTGGAATG
TTAAGTTTCTATAAATGAATGAACCAGTTCTCTCTTGTTTGGAGCAATGCTGAAATTCCAAGAGGCAGCT
AAGTGTGTGAGTGGATCAACAGCCATTTCCACTTATCCAAAGACCTTGATTGCAAGAAGATACGTGCTTC
AACAAAAACTTGGCAGTGGAAGTTTTGGAACTGTCTATCTGGTTTCAGACAAGAAAGCCAAACGAGGAGA
GGAATTAAAGGTACTTAAGGAAATATCTGTTGGAGAACTAAATCCAAATGAAACTGTACAGGCCAATTTG
GAAGCCCAACTCCTCTCCAAGCTGGACCACCCAGCCATTGTCAAGTTCCATGCAAGTTTTGTGGAGCAAG
ATAATTTCTGCATTATCACGGAGTACTGTGAGGGCCGAGATCTGGACGATAAAATTCAGGAATATAAACA
AGCTGGAAAAATCTTTCCAGAAAATCAAATAATAGAATGGTTTATCCAGCTGCTGCTGGGAGTTGACTAC
ATGCATGAGAGGAGGATACTTCATCGAGACTTAAAGTCAAAGAATGTATTTCTGAAAAATAATCTCCTTA
AAATTGGAGATTTTGGAGTTTCTCGACTTCTAATGGGATCCTGTGACCTGGCCACAACTTTAACTGGAAC
TCCCCATTATATGAGTCCTGAGGCTCTGAAACACCAAGGCTATGACACAAAGTCGGACATCTGGTCACTG
GCATGCATTTTGTATGAGATGTGCTGCATGAATCATGCATTCGCTGGCTCCAATTTCTTATCCATTGTTT
TAAAAATTGTTGAAGGTGACACACCTTCTCTCCCTGAGAGATATCCAAAAGAACTAAATGCCATCATGGA
AAGCATGTTGAACAAGAATCCTTCATTAAGACCATCTGCTATCGAAATTTTAAAAATCCCTTACCTTGAT
GAGCAGCTACAGAACCTAATGTGTAGATATTCAGAAATGACTCTGGAAGACAAAAATTTGGATTGTCAGA
AGGAGGCTGCTCATATAATTAATGCCATGCAAAAAAGGATCCACCTGCAGACTCTGAGGGCACTGTCAGA
AGTACAGAAAATGACGCCAAGAGAAAGGATGCGGCTGAGGAAGCTCCAGGCGGCTGATGAGAAAGCCAGG
AAGCTGAAAAAGATTGTGGAAGAAAAATATGAAGAAAATAGCAAACGAATGCAAGAATTGAGATCTCGGA
ACTTTCAGCAGCTGAGTGTTGATGTACTCCATGAAAAAACACATTTAAAAGGAATGGAAGAAAAGGAGGA
GCAACCTGAGGGAAGACTTTCTTGTTCACCCCAGGACGAGGATGAAGAGAGGTGGCAAGGCAGGGAAGAG
GAATCTGATGAACCAACTTTAGAGAACCTGCCTGAGTCTCAGCCTATTCCTTCCATGGACCTCCACGAAC
TTGAATCAATTGTAGAGGATGCCACATCTGACCTTGGATACCATGAGATCCCAGAAGACCCACTTGTGGC
TGAAGAGTACTACGCTGATGCATTTGATTCCTATTGTGAAGAGAGTGATGAGGAGGAAGAAGAAATAGCG
TTAGAAAGACCAGAGAAAGAAATCAGGAATGAGGGATCCCAGCCTGCTTACAGAACAAACCAACAGGACA
GTGATATCGAAGCGTTGGCCAGGTGTTTGGAAAATGTCCTGGGTTGCACTTCTCTAGACACAAAGACCAT
CACCACCATGGCTGAAGACATGTCCCCAGGACCACCAATTTTCAACAGTGTGATGGCCAGGACCAAGATG
AAACGCATGAGGGAATCAGCCATGCAGAAGCTGGGGACAGAAGTATTTGAAGAGGTCTATAATTACCTCA
AGAGAGCAAGGCATCAGAATGCTAGCGAAGCAGAGATCCGCGAGTGTTTGGAAAAAGTGGTGCCTCAAGC
CAGCGACTGTTTTGAAGTGGACCAGCTCCTGTACTTTGAAGAGCAGTTGCTGATCACGATGGGAAAAGAA
CCTACTCTCCAGAACCATCTCTAGGCAACTATCAAAAAGAAGCAGAAGTTCAAGTGGACAAATTTATGTG
AAAATTCATTTAACATATAAGCTGAACTCTATTATGGGGAATGGATACAAAAGCAGAGCTCCCATCTTGA
CTTTCAATTCCTCATCAGAAGTACTGGCTTCTTTAGAGAGTAGTAAGCATGGCTGCCTATGCTTGGAGTC
ATAAGTGTTATTTGGACTATACCCTGAGATAAGCTTATAGATCAAGTTTGGCTCCCTTGAAAAGCATTTC Figure 20 (Continued)

TCTCATGTGCGCCCTCAGGGCTTCCAGCAGGATTGAGTCACCCTGACGATGACCGGGGAGAAGCCGTGTG
CTCTTCATTATTTTCAGCTGGAGGACAGAGCTCAGTGCCTGACTGCCTAGGGTCTCATGGACTGTAGGCA
GCCTGCCAGTGAAGGTCACTGGACTCTAGCCTACAACATGCTGAGCTACAGCCCAGAAGCCAGACATGCC
TGTCTTAGCTGACCTGTTTTTGGTCCACTTTTGCCCTTCCATGACTAATAAGGAAGATATGTGTGTATTT
CATACACACAAGGACCTGGATTAAAAATCCAAAAAGTGATTCTCTTCTATGATTTATTTCAAACTCAT
CCATAGATAATTCAAGATTTGTATTCAAAATAAACATAGTTTTCACAGTTACAAAATAAATCACCTATTT
TATCTTTTCCTTAAAAAAAAAAA

>gi|24234731|ref|NM_024966.2| Homo sapiens sema domain, transmembrane domain
(TM), and cytoplasmic domain, (semaphorin) 6D (SEMA6D), transcript variant 6,
mRNA
GCGGCCGCTTCCCACCGTCCCTCTCCCCTTACTGGCAGAGCGCGCTGCGGGCGGACTCCCGGGCCCGGAG
CAGCCCACCGGCCACCCCACCGCCCACCCGGCTCCCGGTGTCTCCTCCCGGCCGCTCTACCCAGCAACTT
TCCGTGCTTTGTTCCCCGACTGGAAATGCTTTACGGAAGCGTCTTGGACAGGGTCTCCGCCAGGCGACAA
GAGCTCGGTGCTGAGATGTGTTACGTTCTCATCTCCCCATCAATTATGGATGGAAACAAATAAGGAAGAG
TCAATTTTGCTGAGCCCCTTCTCCGGCAACGAGAGGCGTTCTGCAGCCGGGAGGGAGCCGCCGCTCGCGC
CGGCAGCCGCTGGCAGGGGCATGGTGAGGAGGAAGGTAGCTCAGTGGCATTTCTGAGCAGGGGCCACCCT
GACTTCACCTTGGCCCACCATGAGGGTCTTCCTGCTTTGTGCCTACATACTGCTGCTGATGGTTTCCCAG
TTGAGGGCAGTCAGCTTTCCTGAAGATGATGAACCCCTTAATACTGTCGACTATCACTATTCAAGGCAAT
ATCCGGTTTTTAGAGGACGCCCTTCAGGCAATGAATCGCAGCACAGGCTGGACTTTCAGCTGATGTTGAA
AATTCGAGACACACTTTATATTGCTGGCAGGGATCAAGTTTATACAGTAAACTTAAATGAAATGCCCAAA
ACAGAAGTAATACCCAACAAGAAACTGACATGGCGATCAAGACAACAGGATCGAGAAAACTGTGCTATGA
AAGGCAAGCATAAAGATGAATGCCACAACTTTATCAAAGTATTTGTTCCAAGAAACGATGAGATGGTTTT
TGTTTGTGGTACCAATGCATTCAATCCCATGTGTAGATACTACAGGTTGAGTACCTTAGAATATGATGGG
GAAGAAATTAGTGGCCTGGCAAGATGCCCATTTGATGCCAGACAAACCAATGTTGCCCTCTTTGCTGATG
GGAAGCTGTATTCTGCCACAGTGGCTGACTTCTTGGCCAGCGATGCCGTTATTTATCGAAGCATGGGTGA
TGGATCTGCCCTTCGCACAATAAAATATGATTCCAAATGGATAAAAGAGCCACACTTTCTTCATGCCATA
GAATATGGAAACTATGTCTATTTCTTCTTTCGAGAAATCGCTGTCGAACATAATAATTTAGGCAAGGCTG
TGTATTCCCGCGTGGCCCGCATATGTAAAAACGACATGGGTGGTTCCCAGCGGGTCCTGGAGAAACACTG
GACTTCATTTCTAAAGGCTCGGCTGAACTGTTCTGTCCCTGGAGATTCGTTTTTCTACTTTGATGTTCTG
CAGTCTATTACAGACATAATACAAATCAATGGCATCCCCACTGTGGTCGGGGTGTTTACCACGCAGCTCA
ATAGCATCCCTGGTTCTGCTGTCTGTGCATTTAGCATGGATGACATTGAAAAAGTATTCAAAGGACGGTT
TAAGGAACAGAAAACTCCAGATTCTGTTTGGACAGCAGTTCCCGAAGACAAAGTGCCAAAGCCAAGGCCT
GGCTGTTGTGCAAAACACGGCCTTGCCGAAGCTTATAAAACCTCCATCGATTTCCCGGATGAAACTCTGT
CATTCATCAAATCTCATCCCCTGATGGACTCTGCCGTTCCACCCATTGCCGATGAGCCCTGGTTCACAAA
GACTCGGGTCAGGTACAGACTGACGGCCATCTCAGTGGACCATTCAGCCGGACCCTACCAGAACTACACA
GTCATCTTTGTTGGCTCTGAAGCTGGCATGGTACTTAAAGTTCTGGCAAAGACCAGTCCTTTCTCTTTGA
ACGACAGCGTATTACTGGAAGAGATTGAAGCCTACAACCATGCAAAGTAGGTATATGTTACGAGAACGCC
CTTCAGCACTGCTCAAAAATTTTCGGCATGTATTTCATCTAGTCATGTCCTTTGGTCCTCTAAATTAGC
AGTGGTTTGGCATAATAGTGTTTTGTGTTTTTTTCTCATTGAAATAAATCTTGGGTTTGTTTTTTTCCC
GAGCCTGCTAGGGCGAGGGGGGTGAATGGTTGATGAGTTTAAAAATAATGCAGCCCTTGTTTTTCACCTG
TAGAATATGAGAACATTTTAACAGCACCTCTCTTATCTTGCAGATATATTCCAAGATGCTACATGCAGCA

Figure 20 (Continued)

```
GACAGCTGTGAGCTTGCATACACACACACACAAATATACATGCACATACATACACAGAATGCAGTACTAG
TTAAGTATTTCCTTCCTATCTTTAATAAGTAAGAGAATATTTAGACCATT

>gi|93352566|ref|NM_025243.3| Homo sapiens solute carrier family 19, member 3
(SLC19A3), mRNA
CAAGAGCGCCTGGATCCATCCGACAGCCGCGGGTGCGTGGTCGTGCGGCAAGTGAGCGATTTGGTGAACA
GACACTCCCTTCTGTAGCCATGGATTGTTACAGAACTTCACTAAGCAGTTCCTGGATTTACCCCACTGTG
ATCCTCTGCTTATTTGGTTTTTTCTCCATGATGAGACCCTCAGAACCATTCCTTATCCCATATTTATCTG
GACCAGATAAAAACCTGACCAGTGCAGAGATAACAAATGAGATCTTCCCCGTTTGGACATACTCCTACCT
GGTGCTGCTGCTGCCTGTGTTTGTCCTCACCGATTATGTCCGCTACAAGCCAGTCATCATCTTGCAAGGT
ATCAGTTTCATCATTACCTGGCTGCTGCTGTTGTTTGGCCAAGGAGTGAAGACCATGCAGGTTGTAGAGT
TCTTCTATGGGATGGTCACCGCCGCCGAGGTGGCCTACTACGCCTACATATACAGCGTGGTCAGCCCCGA
GCACTACCAGAGAGTGAGCGGCTACTGCAGGAGCGTCACGCTGGCCGCCTACACAGCAGGGTCGGTGCTG
GCTCAACTCTTGGTATCCCTGGCGAACATGTCGTACTTTTACCTCAACGTCATATCCTTGGCCTCTGTCT
CCGTGGCTTTCCTTTTCTCACTTTTCCTACCAATGCCCAAGAAAAGCATGTTTTTTCATGCAAAACCCAG
CAGAGAAATAAAGAAGTCATCAAGCGTGAATCCAGTATTAGAGGAAACTCACGAAGGTGAAGCACCAGGC
TGTGAAGAGCAGAAACCCACATCAGAAATACTCAGCACTTCAGGGAAGCTGAATAAGGGCCAGCTGAACA
GCCTGAAACCAAGCAATGTGACTGTGGACGTTTTTGTGCAGTGGTTCCAAGATTTGAAGGAGTGCTACTC
CTCAAAACGTCTTTTCTACTGGTCTCTATGGTGGGCTTTCGCCACAGCAGGTTTTAACCAGGTTTTGAAC
TATGTTCAAATCCTGTGGGATTACAAGGCGCCATCCCAAGATTCTTCCATCTATAATGGGGCCGTAGAAG
CTATTGCAACCTTTGGAGGGGCTGTGGCTGCCTTTGCAGTGGGTTATGTGAAAGTCAACTGGGACTTCT
GGGAGAGCTGGCTCTGGTGGTCTTCTCAGTTGTCAATGCCGGTTCTTTATTTCTCATGCATTACACAGCC
AATATCTGGGCGTGCTATGCTGGCTATTTGATATTCAAGTCCAGCTATATGCTTCTTATAACCATAGCAG
TATTTCAGATTGCAGTTAATCTGAATGTGGAACGCTATGCCTTGGTATTTGGAATCAACACCTTTATTGC
CTTGGTGATTCAGACCATCATGACTGTGATTGTAGTAGATCAGAGAGGGCTCAACTTGCCAGTCAGCATT
CAGTTTTTAGTTTATGGGAGCTATTTTGCAGTAATTGCTGGAATTTTCCTAATGAGAAGCATGTATATTA
CCTACTCAACCAAATCCCAGAAGGATGTACAGAGCCCTGCTCCAAGTGAGAATCCAGATGTGTCTCACCC
AGAGGAAGAGAGTAATATCATCATGTCAACAAAACTCTAACCTCATCGCAACAAACGCAACAGTGGCTTT
CAAAGTTATGCAATAATAAGGAAAGATTTGAGATGGGTGGCATATGTTTGCCATAACTTGACATGCTT
TGCAAATCTGGATTCCAATGGACCTTTCAAAACCACAACAAAACCTCAGTTTTAGATGAGTTCTCTATGT
GACCAATTTTACTGGATGCAATTGACAGGACCCGTCATCATAATTAAACAACCCATATTGGGGACCCCCT
GTGACTAGTAGCAGCTGGAAAATTCTGGTTTTTATCACTTGTAAAGACATGCAGATGGCGTGGAACCAAA
CCATGAGAAAACTCCAGCCATCCTGGAGTTGATATTCACCATTTGTGAGGAGAAATACTAACTGGACTGA
CCCTATTGCTAGGCTTAAATACTTATTTGATCTTACCAAAGAAGTCAACACATGGGACCTTTGTGTCACA
TGAACCATTTCTTTCCTCTTCTATTAAGTGTATTTCTGTTTAAGTTACAGTTCTCTAAGAGAATTACAA
TGTTTGTCCCATTTCTAAGGGCTTCTCTTCAACTCTAATAACAGCATTATTCACGTTATGATTTGATAGT
ATTATTATTTAATTTTTTATGATTATTTTCCATTTTGTGCTCTGAGTTTTGCTGTTGAAAGTCTCCCTC
AAGAATAGCTTCAGATCCTCTTGTGTATTTGCAGAATACACAAGGTCATTTCCCAGTGGCCTGGGAGAGG
CAGTGAGCCTTCTCTCCACCACCATAGACAGGTGTTAATGCATCTATGGGCCAGGTGCAGTGGCTCACTC
CTGTAATCCGAGCAATTTGGGAGGCCAAGGTGGGAGTTTTGCTTGAGGCCAGAGGTTCAAGACCAGCCTG
GGCAACACAGTGACACCTGACTCTACTAAAAAATTAAAAAATTAGCTGGGCAGCGTGGTGTGTGCCTGTA
GTCTCAGCTACTTGGGAGGCCATGGTGGGAGGATGGGTTGAGCACAGGAGTCAGAGGCTACAGTGAGCTA
```

Figure 20 (Continued)

```
TGATTGCACCATTGCACTCCAGCCTGGGCAACAGAGTAAGACTCTCATCCCCCTCCTCCCAAAAAAGAGC
ACCTGTGTGGTGTCTGTCTAAAATAGGAAAACTTAAAGGAGGTTTCTAGAAGTATTAGAAATAAGAAAAC
ACTGATGGGGGGAGTGGAATAAAACACCTGATTTTGTTTTGTTTTGGTTTTTGAGACAGTCTCGCTCTCT
CACCCAGGCTGGAATGCAATGGCGTGATCTTGGCTCACTGCAAACTTCACCTCCTGAGTTCAAGCCATTC
TCCTACCTCAGCCTCCCAAGTAGCTGGGACTATGGGTGCACACCACCACGCCTGGCTAATTTTTGTATTT
TTAGTGGAGATGGGGTTTCACAATGTTGGCCAGGCTGGTCTCAAACTCCTGACTTCAGGTGATCTGTCTG
CCTCGGCCTCCCAAAGAGCTGAGATTACAGGCGTGAGCCACCATGCCTGGCCAAAACACCTGATTTTTAA
ATGGTAGCAATTGTGCTAAATAAAATGTGTAAAAATTTTAAAGAGTTGTTAACATTTTTTGATGAATTCT
GCTGAAAATTATCTGAACATACCTGTTTTTCGAAACTTCAAGAAACTTCAATAAGGGATGCATTGAGCAG
TCTGACAGTGAGAATAAAGAATGCTGAGTCAAGATTTATATTAAGGCTGGAAGCTGTGGCTCACACCTGT
AATCCCAGCATTTTGGGAGGCTGAAGTGAGAGGTTAATTTGAGGGTAGGGGTATGAGACCATCTTGGCCA
ATATAGCAAGACCCTGTGTCTAAAACAAACAAAAAAATTTTTAATTGGATTTTGATATGGTTTGGATCTG
TGTCCCCACCAAATCTCACGTTGAAGTGTAATCCCCAATGTTAGAGGTGGGGCCGGCTGGGAGGCGACTG
GATCATGGGTGTGAAGCCTTCATGAATGGTTTGGCACCGTCCCCTCAGTGCTGGTCTCATGACAGTGAGT
TATCGTGAGATCTGGTAGTTTAAAAGTGTGTAGCACCTCCCCACTCTCTCTTTCTCCTGCTTTGGCCACG
TGAAGATGCCTGCTCCCACTTTGCCTTCTGCCATGAGTAAAAATTCCCCGAGGACTCCCTAGAAGCAGAT
GTTGCCACGCTTCCTATATAGCCTGTGAGCTAATTAAACCCCTTTTCTTACAAACTAAAAAAAAA

>gi|124256479|ref|NM_030803.6| Homo sapiens ATG16 autophagy related 16-like 1 (S.
cerevisiae) (ATG16L1), transcript variant 1, mRNA
ACTAGCGAGCGCCCTGCGTAGGCACCGGCTCCTGAGCCCGTGCTTCGGGTGAGGGGCGGGTCTTCCGGC
CCTCTCGAAAATCATTTCCGGCATGAGCCGGAAGACCGTCCCGGATGGCCTCGGGGACTGCCAGTGTGTG
GAGGTGAGCTCCGGGATTGCCGGCATTCCCGCTTCTGCTGGTTGCTTCATGCTGCAGGCTGCGGCCGTCA
GCCCTCGCTCGCATTGGTGGCGCTGAGGTGCCGGGGCAGCAAGTGACATGTCGTCGGGCCTCCGCGCCGC
TGACTTCCCCCGCTGGAAGCGCCACATCTCGGAGCAACTGAGGCGCCGGGACCGGCTGCAGAGACAGGCG
TTCGAGGAGATCATCCTGCAGTATAACAAATTGCTGGAAAAGTCAGATCTTCATTCAGTGTTGGCCCAGA
AACTACAGGCTGAAAAGCATGACGTACCAAACAGGCACGAGATAAGTCCCGGACATGATGGCACATGGAA
TGACAATCAGCTACAAGAAATGGCCCAACTGAGGATTAAGCACCAAGAGGAACTGACTGAATTACACAAG
AAACGTGGGGAGTTAGCTCAACTGGTGATTGACCTGAATAACCAAATGCAGCGGAAGGACAGGGAGATGC
AGATGAATGAAGCAAAAATTGCAGAATGTTTGCAGACTATCTCTGACCTGGAGACGGAGTGCCTAGACCT
GCGCACTAAGCTTTGTGACCTTGAAAGAGCCAACCAGACCCTGAAGGATGAATATGATGCCCTGCAGATC
ACTTTTACTGCCTTGGAGGGAAAACTGAGGAAAACTACGGAAGAGAACCAGGAGCTGGTCACCAGATGGA
TGGCTGAGAAAGCCCAGGAAGCCAATCGGCTTAATGCAGAGAATGAAAAAGACTCCAGGAGGCGGCAAGC
CCGGCTGCAGAAAGAGCTTGCAGAAGCAGCAAAGGAACCTCTACCAGTCGAACAGGATGATGACATTGAG
GTCATTGTGGATGAAACTTCTGATCACACAGAAGAGACCTCTCCTGTGCAGCCATCAGCAGAGCAGCCA
CTAAGCGACTCTCGCAGCCTGCTGGAGGCCTTCTGGATTCTATCACTAATATCTTTGGGAGACGCTCTGT
CTCTTCCTTCCCAGTCCCCAGGACAATGTGGATACTCATCCTGGTTCTGGTAAAGAAGTGAGGGTACCA
GCTACTGCCTTGTGTGTCTTCGATGCACATGATGGGAAGTCAACGCTGTGCAGTTCAGTCCAGGTTCCC
GGTTACTGGCCACTGGAGGCATGGACCGCAGGGTTAAGCTTTGGGAAGTATTTGGAGAAAATGTGAGTT
CAAGGGTTCCCTATCTGGCAGTAATGCAGGAATTACAAGCATTGAATTTGATAGTGCTGGATCTTACCTC
TTAGCAGCTTCAAATGATTTTGCAAGCCGAATCTGGACTGTGGATGATTATCGATTACGGCACACACTCA
CGGGACACAGTGGGAAAGTGCTGTCTGCTAAGTTCCTGCTGGACAATGCGCGGATTGTCTCAGGAAGTCA
```

Figure 20 (Continued)

```
CGACCGGACTCTCAAACTCTGGGATCTACGCAGCAAAGTCTGCATAAAGACAGTGTTTGCAGGATCCAGT
TGCAATGATATTGTCTGCACAGAGCAATGTGTAATGAGTGGACATTTTGACAAGAAAATTCGTTTCTGGG
ACATTCGATCAGAGAGCATAGTTCGAGAGATGGAGCTGTTGGGAAAGATTACTGCCCTGGACTTAAACCC
AGAAAGGACTGAGCTCCTGAGCTGCTCCCGTGATGACTTGCTAAAAGTTATTGATCTCCGAACAAATGCT
ATCAAGCAGACATTCAGTGCACCTGGGTTCAAGTGCGGCTCTGACTGGACCAGAGTTGTCTTCAGCCCTG
ATGGCAGTTACGTGGCGGCAGGCTCTGCTGAGGGCTCTCTGTATATCTGGAGTGTGCTCACAGGGAAAGT
GGAAAAGGTTCTTTCAAAGCAGCACAGCTCATCCATCAATGCGGTGGCGTGGTCGCCCTCTGGCTCGCAC
GTTGTCAGTGTGGACAAAGGATGCAAAGCTGTGCTGTGGGCACAGTACTGACGGGCTCTCAGGGCTGGG
AGGACCCCAGTGCCCTCCTCAGAAGAAGCACATGGGCTCCTGCAGCCCTGTCCTGGCAGGTGATGTGCTG
GGTATAGCATGGACCTCCCAGAGAAGCTCAAGCTATGTGGCACTGTAGCTTTGCCGTGAATGGGATTTCT
GAAGATTTGACTGAGGTCTCTCTTGGCCTGGAAGAATAACACTGAAAAAACCTGACGCTGCGGTCACTTA
GCAGAGGCTCAGGTTCTTGCCTTGGGAAACACTACTAGCTCTGACCTTCCATACCTCACTTGGGGGAGCA
CAGGGCCCCGCTGGGCCTCCTCACCAACGGCAGTGCCAAAATCAGCCCCCACATCAAGGTGGTGTTCTCT
GTGCTTTCTCTCGTCCTTCCAAAGTCGGTTCTGGCCTAACGCATGTCCCAACACCTTGGGTTCATTTGCC
CGGTGAACTCACTTTAAGCATTGGATTAACGGAAACTCCCGAACTACAGACCCCTCCCTGGTGGGTTGCA
TGAATGTGTCTCATTACTGCTGAAATGTCCTCACATCTCTTTCACTGTTCTTCAGAGCTTTCTGGCTCTC
TTTCCCCCACAAAATTCGACATATTTAAAAATCTCCGTGTGGCTTTAAAAAATGGTTTTTGTTTTTTTG
TTTTTTTGAGGTGGGAGAGGATGTGTGAAAATCTTTTCCAGGGAAATGGGTTCGCTGCAGAGGTAAGGAT
GTGTTCCTGTATCGATCTGCAGACACCCAGAAGGTGGGTGCACACTGCATGCTTGGGGGTGCCAAGGGAT
TCGAGACCTCCAACATACTTGTCTGAAGGTGGTGATTCTGGCCATGGCCCCTCTGCCAAGCCTGTGTGCG
ATGCCCTTGGTGCTTTAGTGCAAGAAGCCTAGGCTCAGAAGCACAGCAGCGCCATCTTTCCGTTTCAGGG
GTTGTGATGAAGGCCAAGGAAAAACATTTATCTTTACTATTTTACCTACGTATAAAGTTTTAGTTCATTG
GGTGTGCGAAACACCCTTTTTATCACTTTTAAATTTGCACTTTATTTTTTTCTTCCATGCTTGTTCTCT
GGACATTTGGGGATGTGAGTGTTAGAGCTGGTGAGAGAGGAGTCAGGTGGCCTTCCCACCGATGGTCCTG
GCCTCCACCTGCCCTCTCTTCCCTGCCTGATCACCGCTTTCCAATTTGCCCTTCAGAGAACTTAAGTCAA
GGAGAGTTGAAATTCACAGGCCAGGGCACATCTTTTATTTATTTCATTATGTTGGCCAACAGAACTTGAT
TGTAAATAATAATAAAGAAATCTGTTATATACTTTTCAAACTCCAAAAAAA

>gi|226442701|ref|NM_031279.3| Homo sapiens alanine-glyoxylate aminotransferase
2-like 1 (AGXT2L1), transcript variant 1, mRNA
AAAAGGGAGATGATCCTAGCTAGTTGACGCCACCGGTGACCTCCGACGCCCGGGCAAGAGAACGCCAGG
AGGGATAACGGGAGGAAGGCCGGCCGGGGCCGCCAAGGCAGTCCCAGGCTCGCGTAGGAGGCGCGCAGAC
CTTGCACCTTGCACCTTCGCAGCGCCCTGCACCCCGCCACCATGTGCGAGCTGTACAGTAAGCGGGACAC
TCTGGGGCTGAGGAAGAAGCACATCGGGCCCTCATGCAAAGTTTTCTTTGCATCGGATCCCATCAAAATA
GTGAGAGCCCAGAGGCAGTACATGTTTGATGAGAACGGTGAACAGTACTTGGACTGCATCAACAATGTTG
CCCATGTGGGACACTGTCACCCAGGAGTGGTCAAAGCTGCCCTGAAACAGATGGAACTGCTAAATACAAA
TTCTCGATTCCTCCACGACAACATTGTTGAGTATGCCAAACGCCTTTCAGCAACTCTGCCGGAGAAACTC
TCTGTTTGTTATTTTACAAATTCAGGATCCGAAGCCAACGACTTAGCCTTACGCCTGGCTCGGCAGTTCA
GAGGCCACCAGGATGTGATCACTCTTGACCATGCTTACCATGGTCACCTATCATCCTTAATTGAGATTAG
CCCATATAAGTTTCAGAAAGGAAAAGATGTCAAAAAAGAATTTGTACATGTGGCACCAACTCCAGATACT
TACAGAGGAAAATATAGAGAAGACCATGCAGACTCAGCCAGTGCTTATGCAGATGAAGTGAAGAAAATCA
TTGAAGATGCTCATAACAGTGGAAGGAAGATTGCTGCCTTTATTGCTGAATCCATGCAGAGTTGTGGCGG
```

Figure 20 (Continued)

```
ACAAATAATTCCTCCAGCAGGCTACTTCCAGAAAGTGGCAGAATATGTACACGGTGCAGGGGGTGTGTTT
ATAGCTGATGAAGTTCAAGTGGGCTTTGGCAGAGTTGGGAAACATTTCTGGAGCTTCCAGATGTATGGTG
AAGACTTTGTTCCAGACATCGTCACAATGGGAAAACCGATGGGCAACGGCCACCCGGTGGCATGTGTGGT
AACAACCAAAGAAATTGCAGAAGCCTTCAGCAGCTCTGGGATGGAATATTTTAATACGTATGGAGGAAAT
CCAGTATCTTGTGCTGTTGGTTTGGCTGTCCTGGATATAATTGAAAATGAAGACCTTCAAGGAAATGCCA
AGAGAGTAGGGAATTATCTCACTGAGTTACTGAAAAAACAGAAGGCTAAACACACTTTGATAGGAGATAT
TAGGGGCATTGGCCTTTTTATTGGAATTGATTTAGTGAAGGACCATCTGAAAAGGACCCCTGCCACAGCT
GAAGCTCAGCACATCATCTACAAGATGAAAGAAAAACGAGTGCTTCTCAGTGCCGATGGACCTCATAGAA
ATGTACTTAAAATAAAACCACCTATGTGCTTCACTGAAGAAGATGCAAAGTTCATGGTGGACCAACTTGA
TAGGATTCTAACAGTTTTAGAAGAAGCTATGGGAACCAAAACCGAAAGTGTGACCTCTGAGAATACTCCA
TGCAAAACAAAGATGCTGAAAGAAGCCCACATAGAACTGCTTAGGGACAGCACCACTGACTCCAAAGAAA
ATCCCAGCAGAAAGAGAAATGGAATGTGCACGGATACACATTCACTGCTCAGTAAGAGGCTCAAGACATG
ACTGATTTGCATTTTAAAGCAAGATGCGATGTCCAGAGTTACAGAGAATGAGTAGATGTGTCTCATCGGT
TAATAGCTCTATTATACCTCTAAAGGTGGAATTGTCAGTTTAGATTCATAAATGAAAAGGTAAATGAGTA
ATCAGAATAAACCAAGTGATAATCAAACCATGTCAAGATTATTAGTTCAGACTCTAGCCTGTTAATTTTC
TTAGTTGATTTCTGAAGCTACCTGATTTATTCTATTAAATTGTAAGCTTGCAAACTCAAAATAAATTGGC
AGATTTACCTCTCATGTTTTAATGTGTCAAATTAGAGAGCAAAGTATAACAGGTGCCTTCACTTTTGAGA
CTTAGTGCCTTAAAATATGTATTCTATAATGATTTCATATATAAAAGTATATTTATTGACTGTAATAAAA
TAAAATATGATGTAAACAAAAAAAAAAAAAAAA

>gi|30581119|ref|NM_031439.2| Homo sapiens SRY (sex determining region Y)-box 7
(SOX7), mRNA
AAGTTGGACGCCCCGACCCGTGCGAGGGCCAGGTCCGCGCCTGCCCCGCCAGGCGAAGCGAGGCGACCCG
CGTGCGGCCATGGCTTCGCTGCTGGGAGCCTACCCTTGGCCCGAGGGTCTCGAGTGCCCGGCCCTGGACG
CCGAGCTGTCGGATGGACAATCGCCGCCGGCCGTCCCCCGGCCCCGGGGGACAAGGGCTCCGAGAGCCG
TATCCGGCGGCCCATGAACGCCTTCATGGTTTGGGCCAAGGACGAGAGGAAACGGCTGGCAGTGCAGAAC
CCGGACCTGCACAACGCCGAGCTCAGCAAGATGCTGGGAAAGTCGTGGAAGGCGCTGACGCTGTCCAGA
AGAGGCCGTACGTGGACGAGGCGGAGCGGCTGCGCCTGCAGCACATGCAGGACTACCCCAACTACAAGTA
CCGGCCGCGCAGGAAGAAGCAGGCCAAGCGGCTGTGCAAGCGCGTGGACCCGGGCTTCCTTCTGAGCTCC
CTCTCCCGGGACCAGAACGCCCTGCCGGAGAAGAGAAGCGGCAGCCGGGGGCGCTGGGGGAGAAGGAGG
ACAGGGGTGAGTACTCCCCCGGCACTGCCCTGCCCAGCCTCCGGGGCTGCTACCACGAGGGGCCGGCTGG
TGGTGGCGGCGGCGGCACCCCGAGCAGTGTGGACACGTACCCGTACGGGCTGCCCACACCTCCTGAAATG
TCTCCCCTGGACGTGCTGGAGCCGGAGCAGACCTTCTTCTCCTCCCCCTGCCAGGAGGAGCATGGCCATC
CCCGCCGCATCCCCCACCTGCCAGGGCACCCGTACTCACCGGAGTACGCCCCAAGCCCTCTCCACTGTAG
CCACCCCCTGGGCTCCCTGGCCCTTGGCCAGTCCCCCGGCGTCTCCATGATGTCCCCTGTACCGGCTGT
CCCCCATCTCCTGCCTATTACTCCCCGGCCACCTACCACCCACTCCACTCCAACCTCCAAGCCCACCTGG
GCCAGCTTTCCCCGCCTCCTGAGCACCCTGGCTTCGACGCCCTGGATCAACTGAGCCAGGTGGAACTCCT
GGGGGACATGGATCGCAATGAATTCGACCAGTATTTGAACACTCCTGGCCACCCAGACTCCGCCACAGGG
GCCATGGCCCTCAGTGGGCATGTTCCGGTCTCCCAGGTGACACCAACGGGTCCCACAGAGACCAGCCTCA
TCTCCGTCCTGGCTGATGCCACGGCCACGTACTACAACAGCTACAGTGTGTCATAGAGCTGGAGGCGCCC
CGTCCGGTCAGCCCTCGCGCCCTCTCCTTCTTGTGCCTTGAGTGGCAGAGGAGCCGTCCAGCCACACCAG
CTTTCCTCCCACCGCTCAGGGCAGGGAGGTCTGAACTGCGGCCCCAGAGCCTTTGGCCTAAGCTGGACTC
```

Figure 20 (Continued)

TCCTTATCCGAGTGCCGCCTCTATCCCCTTCCCCACGTTCCAGCCCTGCAGCCCACATTTTAAGTATAT
TCCTTCAAGTGAGTTTTCCTCCAGCCCCTGAGAGTTGCTGTCTCCCAGTGGAATGTTCACTGACGTCTTT
TCTTGGTAGCCATCATCGAAACTAATGGGGGGACAGACTTGATAGCCAAGGTCCCTTCTGGTCCAGTTTT
CTGATTTAGGGTTCTCTCAAGATTAATAAAGGAAGATGGGGAAATTTGACTCATTAATGAGCTCGCTAAC
CTACGATCTGGTGATAATTTTGTGTGCACAGCCCAAGGACCACGAGGCTTTCTGCACTTTCTGCACCCCC
TTCCAAAGTGACCACAAAATTTCAAAGGGACTCATACAATTTGAGAAAAAACAGTCAACCTGATTTGAGA
AATTAACCAGTATGGCTAACTATATCACAGAAAATGGGATTGAGTTAAAACTATTTTATTTTAAATATAC
ATTTTAAAGCAGTTCTTTTTTTTTGTTAATTTGTTTATTATACACACACTTCAAGAGAATATGCACAGTC
TAGGCCGGGCACGGTGGCTCACGCCTGTAATCCCAGCACTTTGGGAGGCCGAGGCATGTGGATCACCTGA
GGTCAGGAGTTTGAGACCAGCCTAGACAACATGGTGAAACCTTGTCTCTATGAAAAATACAAAATTTGCT
GGGAGTGGTGGTGCATGCCTGTAATCCCAGCTACTTGGAAGGCTGAGGCAGGAGAATGTCTTGAACCTAG
GAGGTGGAGGTTGCAGTGAGCTGAGATTGCACCATTGCACTCCAGCCTGTGCAACAAGAGTGAAACTCCA
TTTCAAGAAAAAAAAAAAAAAAAGAATATGCACAGTCTGAATGTATACCAGGAGTGTGAGAGACACATGC
CCACTTCATGCAACTCCTAAACTCAAAGTCTAAATCAGATATTTTATTAACAATGACAACTTGTTGCCA
ACTCCCTGTTTCTAATGACCAAAGACCCAGGGTACCTAAAAGGACTTTGCAACCAAGCAAAGTCACTGTC
TTCAAATCTGGATACACACTTTCCCCTCTGTAGATTCAAAAGGTGCTTCCTTCCCGGCTGTCTCCAGCTT
CCTTACTCTCTTTTCTGGGATTTCTTTTTCTCTTCTTTCTGCTCTTCCTCCACTGCTGAACTGGTCCCTA
ACTGAAACAGCCCCTGACTTATCCCAAGCATGCTTCCTTTAGCTGCTGTGAGAATTTGTCTTCCTCACCA
GCCAGGTCCTCAGGCAAAGTCCTCAGCCAGTGCTTTAGAGCAACTTCCCGCAAATCAGAAACTCACTGTG
ATTCCAAAAATGTTTCTGAGCCCTGGACCCCTGCCCCAAAATATTTTCATCTTTCCCCCAAACCTCCTT
TAAAGGAGCATGCATAACAGTGTGCTGAAAGACAGTTGTTGGTTTTTGATTTTAGCATATTATTTCCTG
TATGAAATATGTTTTATATAATCTCCTATTATTTTTATCTTATGTTTTGTATTGTTGATAAATCCTTTTT
GTCCTTCTAAGATGTCCTATTGTAAAATCACTTATAAGGTATGATTACTCTTTATGCTATTACTTTATAT
GCCATTTGGTAATAAATAGTAAATTGTTGATGATATGATTGACTGATGCGCAGTCCAGAGCATGTATGAA
TAATCTCATAAAACAGTATCACAGACATTAAGCTAAACTGTTTCGTTTTTTGAAAGAACAACTCATACT
TTGGAACAGTTGTCAATATTAATTTGTTGCAAATATTTAATTTAAATAAACATTTTTGTACCATGAAAA

>gi|29826292|ref|NM_031899.2| Homo sapiens golgi reassembly stacking protein 1, 65kDa (GORASP1), mRNA
GAATCGAGCGCCGAGAGAGCGAGTCGGTGCTACTGGCGCCGGGTCGGTCCGGGTAGGCGCAGCGGGACTG
GACCTGGGTGCCGAGCGGAGCCGCTGCCATGGGCCTGGGCGTCAGCGCTGAGCAGCCCGCAGGCGGCGCC
GAGGGCTTCCACCTCCACGGGGTGCAGGAGAACTCCCCAGCCCAGCAGGCGGGCCTGGAGCCCTACTTTG
ACTTCATCATCACCATTGGGCACTCGAGGCTGAACAAGGAGAATGACACCCTGAAGGCACTACTGAAAGC
CAATGTGGAGAAGCCCGTGAAGCTGGAGGTGTTCAATATGAAGACCATGAGGGTGCGCGAGGTGGAGGTG
GTGCCCAGCAACATGTGGGCGGCCAGGGCCTACTGGGTGCCAGTGTGCGCTTCTGCAGCTTCCGCAGGG
CCAGTGAGCAGGTGTGGCATGTGCTGGATGTGGAACCATCTTCACCTGCTGCCCTTGCCGGCCTGCGCCC
CTACACAGACTATGTGGTTGGTTCGGACCAGATTCTCCAGGAGTCCGAGGACTTCTTTACGCTCATCGAG
TCTCATGAGGGGAAGCCCTTGAAGCTGATGGTGTATAACTCCAAGTCAGACTCCTGCCGGGAGGTGACTG
TAACTCCCAACGCAGCCTGGGGTGGAGAGGGCAGTCTGGGATGTGGCATTGGCTATGGGTATCTACACCG
GATCCCAACTCAGCCCCCAGCTACCACAAGAAGCCACCTGGCACCCCACCACCTTCTGCTCTACCACTT
GGTGCCCCACCACCTGATGCTCTACCACCTGGACCCACCCCCGAGGACTCTCCTTCCCTGGAGACAGGTT
CCAGGCAGAGTGACTACATGGAGGCCCTGCTGCAGGCACCTGGCTCCTCCATGGAGGATCCCCTTCCTGG

Figure 20 (Continued)

```
GCCTGGGAGTCCCAGCCACAGTGCTCCAGACCCTGATGGACTTCCCCATTTCATGGAGACTCCTCTTCAG
CCCCCACCTCCAGTGCAGCGAGTTATGGACCCAGGCTTCCTGGACGTGTCGGGAATTTCTCTCTTGGACA
ACAGCAATGCCAGTGTGTGGCCCAGCCTGCCCTCTTCCACAGAACTGACCACCACAGCTGTCTCAACCTC
AGGGCCAGAGGACATCTGCTCCAGCAGCAGTTCTCATGAGCGGGGTGGTGAGGCTACATGGTCTGGGTCA
GAGTTTGAGGTCTCCTTCCTGGACAGCCCAGGTGCCCAAGCCCAGGCGGACCACCTGCCTCAGCTGACTC
TTCCTGACAGTCTCACCTCTGCAGCCTCACCAGAAGATGGGCTGTCCGCCGAGCTGCTTGAAGCTCAGGC
TGAGGAGGAACCAGCAAGCACAGAGGGCCTAGATACTGGGACGGAGGCTGAGGGCTGGACAGCCAGGCC
CAGATCTCTACCACAGAATAACACCCTGGGCTGTGACAAGGCCATGATGACATTTCATGAGGCCCAGAT
GTGGGCAGGCAGCCCGGGCTGCACTATGCGGTCAGGATTCCTTGCTGCTTTGGTGGGACATGAGGCCTCA
GTGGGTGGTGAGAGGGGGCCATGGGCCTTGTGGGAGGATATCTTTTGGCCGTGTACCCTCAGGTCCAGTG
CTTGGTCCTGCTCTGGTCACTGGGGCTTCCCAGGAGGCAGCAGGGTCTGGTCATAATCCAGTGTGAAGAT
GAGGTGAGGAAGGAAGGGGTTGCTGTCCAGTGTTGGCCTGGTCGCTTTGATTCTTCCTGCACAGCTCAGC
CCACCCCATCTGTACTGGAAGGGACCCTGGAGCCCTGGGACCACCCCCTTTCAAGTCCCAAACACTGAGT
CCTCTGTCATGTGTCCTTGTCCCTAGGCTACAATGCTACACTTGGCTCAGGCTGATCACCATGCTAGTCA
CAGGAGGGAGAGAGAGGCAGTGTACTTGCCCCCATCTCCTGGAGGGAGGTGCGTTGGAAATTCTAGGCCC
TTCAGCAGAGACCCATTTGTGCCCAGACCACAATATTTCTTCTTCCTCAGGGACTACATGCCACAGACCT
GTATCCCCAGTGGCAACTCCTGTTAGCTCCCAAACTTAAACAGTGATCTCTTCTAAATATACAAGGCATC
TACCCAGCCCCAATAGTGAATAAAAGTCACAAATTTAAGTTCAACACCCTAAGCAATTTCTCAAAGCCAG
TCTACCTGACTAGGTCTATCCACGCACGGTTCCCAACCCCAAGGGGGAATTAGGGGATTAGATTAAGAGT
AGGTAAAGACCCTTTTGTTCTTTCCTGTTGTAGGGGAGGAAGCTGTTCTCCCCACCCCAGGTGCCTTTGG
AGGTTAAGGCTAGGTTAGGCCCTGCACTCCACCTGGGACGGCCCCTCATCACCTGAAGTCCTCTGCTGT
GTTGACTGGACCCTCAGTTCCCACACTGCTAATTACTATGAAAGCTGCTCTGGCCTCGTCTTCTAGCTTG
TGCCTAGTTGAAAGTCTCACCTTTACAGGATCATTTGTAATGCTGGTGTACATGCAGGGAACTCACAAGC
TGTGTCAGGTATGCAGGACAAGGAATGTCTGCTCTGGGGGGCACAGGCCAACTATATGGAGGGAGGGTCC
CAAATTAGCAAACCCTTCATTTAAAGCAAACCCTTGTCAAGCCTACCAGAGCAGCTGATACGTGTGCATA
ACAGTGAGGCATTGTGTCCTGGATCGTCTGGGAGCCCAGTGTCAAGTCTGCTGGAATGCAGGAAGTAGAA
CAGAATCGCCACAGGACTGTTCTGGGGCCAGCTTCCCTTAACTCTGTAGCCTGGCAGTCTGACCCAAAGT
TGCCCTCACCCAAAGGTTCTGGCTCTTCCCTCCCTCACTTTTACTTTCCCTTCCCCCATAAGTTGGAGGA
TAAAATGGGTATCAATGCTAATATTTCCAGGGAGAACATGAAACCAGAGGTTTCTTTCTTTCTCTGTAAT
CTGCTATGAAAGAAAATAACAAATGAAAATAAATGTGTACTACACTTTGAAATATTTTAACTAAAGCCTT
TATTCTATACAACTGTGAAATACAGATTTTTACCCTTTTGGCATTGC

>gi|29826300|ref|NM_032146.3| Homo sapiens ADP-ribosylation factor-like 6 (ARL6),
transcript variant 1, mRNA
GCCTGCCAAGGCGCCTGCTCAGCGACTGATGCACAGACTGCTGCAGAGGCTGCCGGTTTTCCCAACTTCT
AGAGACGGCTTTGCTCATTACCAGGCATCCTTCCCATGTAGGCATCGAGAAGAAGGCTGAGGGACCCTCG
CACCAGATTTCCATCCCGGAGACCGATACGAGTGCGTCCATTCCTGTTGCCAGCTCCTGCGCCCTCCGGA
CTAACCTCAAAAACCAGAAAACTGCCTGCTCTTCTAAATTGTGTGTCCCAAAATATTTCATTAACAAGT
ATCAAGTGATAATCCATGGAAAAGTGATGGAAAGTCACAATACAAGCTGGTTTGTAAATATTTGAATCAC
ATTATGGGATTGCTAGACAGACTTTCAGTCTTGCTTGGCCTGAAGAAGAAGGAGGTTCATGTTTTGTGCC
TTGGGCTAGATAATAGTGGCAAAACGACGATCATTAACAAACTTAAACCTTCAAATGCTCAATCTCAAAA
TATCCTTCCAACAATAGGATTCAGCATAGAGAAATTCAAATCATCCAGTTTGTCATTTACAGTGTTTGAC
```

Figure 20 (Continued)

```
ATGTCAGGTCAAGGAAGATACAGAAATCTCTGGGAACACTATTATAAAGAAGGCCAAGCTATTATTTTTG
TCATTGATAGTAGTGATAGATTAAGAATGGTTGTGGCCAAAGAAGAACTCGATACTCTTCTGAATCATCC
AGATATTAAACACCGTCGAATTCCAATCTTATTCTTTGCAAATAAAATGGATCTTAGAGATGCAGTGACA
TCTGTAAAAGTGTCTCAGTTGCTGTGTTTAGAGAACATCAAAGATAAACCCTGGCATATTTGTGCTAGTG
ATGCCATAAAAGGAGAAGGCTTGCAAGAAGGTGTAGACTGGCTTCAAGATCAGATCCAGACTGTGAAGAC
ATGAAAAGATAATAGTTGGAAACCTCAGCAATTTTCAATTCAAGGAATCTATCTAAGACAAATAGAATAC
ATTTTGTAAAAGATGTTTATGCATCAAAAAATATAATTTTCTGCTTGCATTTATGGACTCTGACCTTTTT
AAGAACATAGGACTTCAGGTATGCTAATTTGGCCATTAATTATTTAAAAACTAAATATTCCCTCAAAAGG
GCTCCCTAGAATTATCAAGTTCTTAGTGAAGGTCTACATTTGATTGTACGTAGAATGTTTAAAAGTCAGT
TATAAGCCATCTCATCCCATCATAATTTATGATATGTTTAATATATTTTATTTTTTAATTGTCTTTTTAA
AAAATTTAGTTTATGACTTTGCAGTATGAATTGTGCTTGTGAAAAAGAACTTTAAATATTTATAAGGGAC
CATGGGTAATTAATATATATTCAATTTTTACTATGTGTCACTGTCAATAAAATGTAAAATATAAAAAAAA
AAAAAAAA

>gi|339275990|ref|NM_032204.4| Homo sapiens activating signal cointegrator 1
complex subunit 2 (ASCC2), transcript variant 1, mRNA
GAGACTTCCTGTCTGCTCCTGCGGAATCGCAGTTTGACCCCGGAAGTGCGGGCGCTCAGGGAGCTGTCAC
CGTGGTCGGCGGCGGCGGCGGCGGCGGCGGCACAGAGCCGGTGGTGGAGCCGCCGAGGAGGGTCACGCAG
CACAATGCCAGCTCTGCCCCTGGACCAACTCCAGATCACCCACAAGGACCCGAAGACAGGAAAGCTGAGG
ACTTCACCAGCGCTGCACCCCGAGCAGAAGGCAGACCGGTATTTTGTGTTATACAAACCGCCCCCTAAAG
ACAACATTCCCGCCCTAGTGGAGGAGTACCTGGAACGCGCCACCTTCGTAGCCAATGACCTCGACTGGCT
CCTGGCCTTGCCTCACGATAAATTCTGGTGCCAGGTGATCTTTGACGAGACTCTACAGAAGTGCCTGGAC
TCCTACCTGCGCTATGTCCCCCGCAAATTCGACGAGGGGTGGCCTCAGCCCCTGAGGTTGTTGACATGC
AGAAGCGCCTCCATCGAAGTGTTTTTCTCACCTTCCTCCGCATGTCCACTCACAAGGAATCCAAAGATCA
CTTCATTTCCCCTTCTGCGTTTGGAGAAATCCTCTACAATAACTTCCTCTTTGACATTCCAAAGATCCTG
GACCTCTGCGTGCTCTTTGGAAAAGGCAACTCACCACTGCTCCAGAAGATGATAGGAAACATCTTTACAC
AGCAGCCAAGTTACTACAGTGACCTGGATGAAACCCTGCCTACCATCCTTCAGGTCTTCAGCAATATCCT
CCAGCACTGTGGTTTGCAAGGGACGGGGCCAATACCACACCCCAGAAGCTTGAGGAGAGGGCCGATTG
ACCCCCAGTGACATGCCTCTCCTGGAATTAAAGGACATTGTTCTCTACCTTTGTGATACCTGCACCACAC
TTTGGGCCTTTCTGGATATCTTCCCTTTGGCTTGCCAGACCTTCCAGAAGCACGACTTTTGTTACAGACT
AGCTTCCTTCTACGAAGCAGCAATTCCCGAAATGGAGTCTGCAATTAAGAAGAGGAGGCTTGAAGATAGC
AAGCTTCTTGGTGACCTGTGGCAGAGGCTCTCCCATTCCAGGAAGAAGCTAATGGAGATTTTCCACATCA
TCCTGAACCAGATCTGCCTCCTTCCCATCCTAGAAAGCAGCTGTGACAACATTCAGGGCTTCATCGAAGA
GTTCCTTCAGATCTTCAGCTCCTTGCTGCAGGAGAAGAGGTTCCTCCGGGACTATGATGCACTCTTCCCC
GTGGCCGAAGACATCAGCTTGCTGCAGCAGGCCTCATCAGTCTTGGACGAGACGCGGACTGCCTACATCC
TCCAGGCAGTCGAGAGTGCATGGGAAGGGTGGACAGACGGAAAGCCACAGATGCTAAAGACCCATCGGT
GATTGAGGAGCCTAATGGGAGCCTAACGGGGTCACGGTGACAGCAGAGGCAGTCAGTCAAGCATCATCA
CATCCGGAGAACTCGGAGGAAGAGGAGTGCATGGGAGCAGCCGCGGCTGTGGGCCCTGCCATGTGTGGGG
TGGAACTGGACTCTCTCATCTCCCAAGTGAAGGACCTGCTGCCAGACCTTGGTGAGGGCTTCATCCTGGC
CTGCCTGGAGTACTACCACTACGACCCAGAGCAGGTGATCAACAATATCCTGGAGGAGCGGCTGGCCCCC
ACCCTCAGCCAGCTGGACCGCAACCTAGACAGAGAAATGAAACCAGACCCTACACCCCTGCTGACGTCTC
GCCACAACGTCTTCCAGAATGACGAGTTTGATGTGTTCAGCAGGGACTCAGTAGACCTGAGCCGGGTGCA
```

Figure 20 (Continued)

```
CAAGGGCAAGAGCACCAGGAAGGAGGAAAACACGCGGAGTTTGCTGAACGACAAGCGTGCAGTGGCGGCA
CAGCGGCAGCGCTACGAGCAGTACAGCGTGGTGGTGGAGGAGGTGCCACTGCAGCCAGGCGAGAGCCTGC
CCTACCACAGTGTCTACTACGAGGATGAGTACGATGACACATACGATGGCAACCAGGTGGGCGCCAATGA
TGCAGACTCTGATGACGAGCTCATCAGCCGCAGGCCATTCACCATCCCTCAGGTGCTGAGAACCAAAGTG
CCTAGAGAAGGGCAGGAGGAGGATGACGACGATGAGGAAGACGATGCTGACGAGGAGGCTCCCAAGCCCG
ACCATTTTGTTCAGGACCCTGCAGTGCTGAGAGAGAAGGCAGAAGCCAGGCGCATGGCCTTTCTCGCCAA
GAAAGGGTACCGGCATGACAGCTCAACAGCAGTGGCCGGCAGCCCCCGAGGCCATGGGCAGAGCCGCGAG
ACAACCCAGGAACGCAGGAAGAAGGAAGCCAACAAGGCGACAAGAGCCAACCACAACCGGAGAACCATGG
CCGACCGCAAGAGGAGCAAAGGCATGATCCCATCCTGAGACCTGGTGCAGGGCCAGTGGGGAGGCAGCGG
CACCAGACTCACCAGGCCGTGCTCCCATCGCCTGGGGCCTCCTCACTAGGGGCCCAAGTTCAACTCAAC
CCCTCAACAGCCTCAGCTTTGCAGCCCCTGAGAAGGCCGCCTCTCATCTACCAGCCAGCCATGAGCGCCT
TCCTGCAGAACACACAGTGCCTTATGCCACAGCCGAAGAATCCGTGGGGCCGGCAAGCAGGCACCTTCCC
CCAGCTGCGCTAGCGGGAAAGAGATGGGGATGGAGTCCCAAGGCAAGCGCCCCAAACCTCGGGCCACAAG
ACACCACTTCCCCTTTACCCTGGACAGCAGGAAACCTGTATATTCAAAAACACAAAAAGTCCTGCTAATA
AAATTTTTGACCCTTTCAAACGAAAAAAAAAAAAAAAAAA

>gi|209364605|ref|NM_032237.3| Homo sapiens protein kinase-like protein SgK196
(SGK196), mRNA
CAGTGCGTGCTGGCCCGGGGTGGCAGGAGCCGCAGAGGCTTGGGCTGCAGAAAAAGGATCCTGTTTGCTG
TGTAATCCTGAGAATGGACTGCAAGAGAGGAAAAACTGGGCGTCTGCTTGGGAATCTATTGTGGAAACCC
AGGGTGTTTCCCGACCAGTCCCTGGGCGCCAACTAGAGTATGGACTGACCAGGTACCTGGATGGAGACCT
GAGCTGGAGAAGGAGATGCGCTTGGGAGGAAATTGCAGAGGCCGTCAACATGGAAAAGCAGCCCCAGAAC
AGCAGGAGAGGCCTCGCCCCCCGAGAGGTGCCGCCAGCTGTTGGGCTGCTGCTGATCATGGCCCTGATGA
ATACTCTGCTCTACCTCTGCCTCGACCACTTCTTCATCGCTCCTCGACAATCCACTGTGGACCCCACACA
CTGTCCCTATGGTCACTTCAGGATAGGACAGATGAAAAACTGCTCACCTTGGCTGTCCTGCGAGGAGCTG
AGAACAGAAGTGAGACAGCTGAAGCGTGTTGGGGAAGGAGCTGTAAAGAGAGTCTTTCTGTCTGAGTGGA
AGGAGCACAAAGTTGCACTCTCACAGCTCACCAGCCTGGAGATGAAAGATGATTTCCTCCATGGACTGCA
GATGCTGAAATCTCTCCAAGGCACACATGTTGTCACGCTGCTTGGCTATTGTGAGGATGACAACACTATG
CTTACTGAATATCACCCTCTAGGTTCCTTGAGTAACCTGGAAGAAACACTAAACCTTTCAAAGTACCAAA
ATGTGAACACGTGGCAGCACAGGCTGGAGCTGGCCATGGACTATGTCAGCATCATTAATTACCTGCACCA
CAGCCCTGTGGGCACACGGGTCATGTGCGACTCCAACGACCTGCCGAAGACACTGTCCCAGTATCTGCTA
ACAAGCAACTTCAGCATTTTGGCAAATGACTTGGACGCCTTACCCCTGGTGAACCACAGCTCCGGGATGC
TGGTGAAGTGCGGCCACAGGGAGCTGCATGGGGATTTCGTGGCTCCAGAGCAACTGTGGCCCTATGGAGA
GGACGTGCCTTTCCACGATGATCTCATGCCCTCATATGATGAAGATTGACATTTGGAAGATCCCAGAC
ATCTCCAGTTTCCTTCTGGGGCACATTGAAGGGAGTGATATGGTCCGATTCCATTTGTTTGATATTCACA
AAGCATGCAAGAGCCAGACTCCCTCAGAAAGACCCACTGCCCAGGACGTTCTGGAGACCTACCAGAAGGT
CTTGGATACACTTAGAGATGCCATGATGTCTCAGGCAAGAGAGATGCTGTGAAAACCAGTCCAGCCAATG
AAGGTGGGATTGAAGGGCTGAATGGAAGTTACAGCATTCTACTCTGATGGTGGAGTTTTTGCCTGAGTT
TCGTGTTTTATTGTTTTTTTATGGCTTAGCCATGTGGTTCGTTGTCCACATCCACATGTACGTTTGTAT
GTAGTCCACATTGGTTGTTAGATTTTTTTTTTTCTTTGAGATGCGGTCTTGCTCTGTTGCTGAGGCTG
GAGTGCAGTGATGTGATCTTGGCTCACTGCAGCCTCTGCCTCCCAGGTTCAAGCAATTCTCCCACCTCAG
CCTCC
```

Figure 20 (Continued)

```
>gi|141803454|ref|NM_032289.2| Homo sapiens pleckstrin and Sec7 domain containing
2 (PSD2), mRNA
CTCGCTCAGCCTCTCCACATCGCGGCTCCGGCACCTGAAGGGACGCGGGCGGGCGCGGGCAGCTCCGACC
GGCGGCGGCGGGGCGGGACAGGCAGCCCGGCGGCCTCCGATGGCCCCGCCGTGAGAGGCCGGACCCGCGG
CGGGGACCAGCAGCGGTCTAGAGGAGTCCCAGGAGCAGCCAGGACAGGCGGAAGCAGTGGCTGCCATGGA
GGAGGACAAGCTCTTATCTGCAGTGCCTGAGGAAGGCGATGCCACCCGTGACCCCGGTCCAGAGCCTGAA
GAGGAGCCAGGGGTCCGGAATGGGATGGCCAGTGAGGGCCTGAACAGCAGCCTCTGCAGCCCAGGGCACG
AGCGAAGGGGCACCCCAGCGGACACTGAGGAACCCACGAAGGACCCAGATGTGGCCTTCCATGGCCTCAG
CCTTGGCCTCTCTCTCACCAATGGCCTAGCCCTGGGGCCAGACTTGAACATTCTGGAAGATTCAGCGGAG
TCCAGGCCCTGGAGGGCTGGCGTGCTGGCAGAGGGGACAATGCTTCCAGGAGCCTCTACCCAGATGCTG
AGGACCCTCAGCTGGGGTTGGATGGTCCCGGGGAGCCAGATGTGCGGGATGGCTTCAGCGCCACGTTTGA
GAAGATTCTGGAGTCAGAGCTGCTGCGGGGCACCCAGTACAGCAGCCTCGACTCCCTAGACGGGCTGAGC
CTCACGGATGAGAGCGACAGCTGCGTCAGCTTCGAGGCCCCCCTCACACCCCTCATCCAGCAGCGGGCCC
GTGACAGCCCTGAGCCAGGGGCTGGGTTGGGCATTGGGGACATGGCGTTTGAGGGGGACATGGGGGCAGC
TGGTGGTGATGGGGAGCTGGGCAGCCCCCTGCGGCGCTCCATCTCCAGCAGCCGCTCTGAGAATGTCCTG
AGCCGCCTGTCTCTCATGGCCATGCCCAATGGATTCCATGAAGATGGCCCTCAGGGCCCAGGGGGGGATG
AGGATGATGATGAGGAGGACACGGACAAGTTGCTGAACTCAGCCAGTGACCCCAGCCTGAAGGATGGCCT
GTCAGACTCAGACTCTGAGCTCAGCAGCTCGGAGGGGTTGGAGCCTGGTAGTGCAGACCCTCTGGCCAAC
GGGTGCCAGGGGGTCAGTGAAGCTGCTCATCGGCTGGCACGCCGTCTCTACCACCTCGAGGGCTTCCAGC
GCTGTGATGTGGCCCGGCAGCTGGGCAAGAACAACGAGTTTAGCAGGCTGGTGGCCGGGGAGTACCTCAG
TTTCTTCGACTTCTCGGGCTTGACTCTGGACGGAGCACTCAGAACATTCTTGAAGGCCTTCCCGCTGATG
GGGGAGACACAAGAGCGTGAGCGGGTCCTCACACACTTCTCCCGCCGGTACTGCCAGTGCAACCCTGATG
ACAGCACTTCGGAAGATGGGATCCACACGCTCACCTGTGCCCTGATGCTGCTCAACACGGACCTGCACGG
CCACAACATTGGCAAAAAGATGTCCTGTCAGCAATTCATTGCCAACTTGGACCAGCTGAATGATGGCCAA
GACTTTGCCAAAGACCTGCTGAAGACCCTTTACAACTCCATCAAGAATGAAAAGCTGGAATGGGCCATTG
ATGAGGATGAGCTGAGGAAATCCCTGTCTGAGCTGGTGGATGACAAGTTCGGGACAGGCACGAAGAAGGT
GACGCGAATCCTGGATGGTGGCAACCCCTTCCTGGATGTCCCACAGGCGCTCAGTGCCACCACCTACAAG
CACGGCGTCCTGACCCGGAAGACTCACGCTGACATGGATGGCAAGAGGACGCCCCGTGGGAGGCGTGGCT
GGAAGAAATTCTACGCAGTGCTCAAAGGGACCATCCTGTACCTGCAGAAGGATGAGTACAGGCCTGACAA
AGCTCTATCGGAGGGTGACCTGAAGAACGCCATTCGCGTGCATCACGCTCTGGCCACCAGGGCCTCTGAC
TACAGCAAGAAGTCCAACGTGCTGAAGCTTAAGACAGCCGACTGGAGGGTATTCCTCTTCCAGGCACCGA
GCAAGGAAGAAATGCTGTCCTGGATCCTCAGGATCAACCTGGTGGCAGCCATCTTCTCTGCCCCGGCCTT
CCCAGCCGCTGTCAGCTCCATGAAGAAGTTCTGTCGGCCCCTGCTGCCCTCCTGCACCACCCGCCTCTGC
CAGGAGGAGCAACTGCGGTCTCATGAGAATAAGTTGAGGCAGCTGACTGCGGAGCTGGCCGAACACAGGT
GTCACCCAGTCGAGAGGGCATCAAGTCCAAGGAGGCCGAGGAGTACCGGTTGAAGGAGCACTATCTCAC
CTTCGAGAAAAGCCGTTATGAGACCTATATCCACCTCCTGGCTATGAAAATCAAAGTGGGCTCAGATGAT
CTGGAGCGGATTGAGGCCCGGCTGGCCACTCTGGAAGGGGATGACCCTTCTCTCCGGAAGACACATTCAA
GCCCTGCCCTCAGCCAGGGCCATGTGACTGGCAGCAAAACCACAAAGGATGCCACTGGGCCTGATACTTA
GCTGACATGGATTTGCAGACCCCAGGGTGGGCAGATGTCTCCAGTGGGGTCAGTGAGCACAATTCCAGCC
AGGGGCCACTTGGACCAAGCTCCAGTCAGTTGATGGGCAGCTAGAGGGGTGCAGAAAGCCTGTGGGCCCA
GGAGATGGAGATGCCGTTTGTGGCGTTGATCTCCTTGCGTCCTTGGGCATCTCCGGGCATCAGACCCTCT
```

Figure 20 (Continued)

```
CCCTGGCCCTTGTTTTCCTCTCCACCATGGAGCCTCATTTTGTAGGCCAGTTGTGTGCATGCTCTAGACA
CCACCTCGCTGGAGAAGCTGGAAGGGCTGTTGTCTTCCCAGGTCTTTCTCTTCTCATCAAGCTCCTCTCC
TCATCTTTTTTGTGTGTGAGGGCAGGTCTTGACTCTAGGTCTCAGCTGGAACCCCACCCTTTCTCCTCCT
CCTTCCTCTGAGTTGACCAGCAGCAGGTCTGCCGACCACCAGCACCATCCTCTCCTCCCAGCAGCCTCCA
GAACCATGCCCAGGTCTCCTGCCTCACATCACAATAATCTGGGACCCAGGCTTGTGCCCTTTCAGTGTAA
AGCTGACTCCATCACATGTGCATCCACTTCTTTTCATCCATTGAGATCACACTGCCTCCTTTTTATACAG
ACACAAATATACATCTATAAGAATAATATATACATAAGGAACCCCTGAAAGATGGTTTTGGAACTGGAAT
CAGTTAGAGGATGAAATCAGATAAAGGAAAAGCCTATTTTGGAGCTTCCCCTGTTAGGAAGGATGGCTGC
ACCTGGCCCCCTGGCATTCCTGACGCTCTAGGAGGGAAGGGGGAGGCAGTGCTGGCCTCCCTTGCCCTGT
TTTTCCCTCTTCCAGCTGACCTGTGACTTATACTGCTCTTACCGATGATACTTTTGGAAAAAATAGAGCG
TGTATGCACCGCCCCGTTTGTCCCATGGATATCCTGGGGTGTGAGTCGGATGGGACCACGGCCCTGTTTA
TATTTGGGTCTTTATGTTGGTGCTGCCAGGTCTCTGAGCTCCAGAGGTGGCCTCTTGGACAGATCTACTG
CTATAGGAATAAAAGACACTCTGTCTCGCAAATGGCTGCTTGTCAACAAGCCCAAAGATGCTTGTCGGAG
GACGGTTATGGAAGCCCTTAATTCTTGGTTGTGGGAAAAGGTGGAATGACAAGTTATTGATTGTTTTCT
GTCGCTATTTCTTTCATTTGTCTAGTGAATCAGAAAGGCTTAGCCAAGGCCACATCTGGGAAGAGTGGAG
AAATTTGCCACTTGACGATCACGGATTAGCTAGCACCTTTAAGCCCTGCATTTCTCCAACTGACAAGTGG
GTGGGGGTGATGGCACATTCAGTGTGGCTATGAAGAGCGAATCCTCTCTATTGTTTAAATAGATTACTGT
AGTTTGGCCAGGAATTTGGCGTCAGTGGTAACACACTTAGTTAATAAAATAAGCCAGGCTTGCAACTAAG
TATCTAACTTTACAGGCCCACTCACATTTGAGGCAAGGGCTATTGAGTATGTGGAGAGATGTAGTGATT
TAAATTCAGATTATTTAAGTTGGATCAGCTGAAGTGTGTTTAGACCCAAACCATCTGGCCCCTTCGTTT
TGCTCAGAGGAAGTAAATGTTCACTTAAATGAAATTGAAAACGCCATGTGGCACCACAAAAGAGCTCTCT
GTACTTTCCCCATGCTGCCTCAAAAGTTCTGTGAGTTTCGGGGTCAGTGTCCCACCCTTCACTTCCCGAG
GGCGGGTGAGTGGAGAGCAGAGCCAGGAGCTCTGGCAGCTGTGGACAGATGTGCTTCCTGAGCATGGGTT
GTGCCTCCCATCAGTAAAAAAATGTTTAGTTCACTTCCTTAATTGTATAATTATTTATTTGTAAATTATA
TACATGTACTACTGTACTAAAATATTATGTACATTATAAAACATACACAAAAATAGAAATTTAAAAAAGA
TGAGATGAAAATAAATCTAAGTCAAAGTTCCAAAAAAAAAAAAAAAA
```

>gi|40255081|ref|NM_032368.3| Homo sapiens leucine zipper and CTNNBIP1 domain containing (LZIC), mRNA
```
GGTGGTTTGAACTTTGAGCCTTTTGTAGTCCTGATGAATAATTTCATTTTCCTCAAGTTTATGACACTCG
GAACGTCAAGAACTGGAGGTTTGTGCAATTTGAGACCGGTCGGCACTGTGCAGAGATCAGAGTACTAAGA
GACAGAGATTAAAATGGCTTCCAGAGGAAAGACAGAGACAAGCAAATTAAAGCAGAATTTAGAAGAACAG
TTGGATAGACTCATGCAACAATTACAAGATCTGGAGGAATGCAGAGAGGAACTTGATACAGATGAATATG
AAGAAACCAAAAAGGAAACTCTGGAGCAACTAAGTGAATTTAATGATTCACTAAAGAAAATTATGTCTGG
AAATATGACTTTGGTAGATGAACTAAGTGGAATGCAGCTGGCTATTCAGGCAGCTATCAGCCAGGCCTTT
AAAACCCCAGAGGTCATCAGATTGTTTGCAAAGAAACAACCAGGTCAGCTTCGGACAAGGTTAGCAGAGA
TGGATAGAGATCTGATGGTAGGAAAGCTGGAAAGAGACCTGTACACTCAACAGAAAGTGGAGATACTAAC
AGCTCTTAGGAAACTTGGAGAGAAGCTGACTGCAGATGATGAGGCCTTCTTGTCAGCAAATGCAGGTGCT
ATACTCAGCCAGTTTGAGAAAGTCTCTACAGACCTTGGCTCTGGAGACAAAATTCTTGCTCTGGCAAGTT
TTGAGGTTGAAAAAACAAAAAAATGACATGGTGCAGAAGCTTGTAACATTGATCACATTCTTAATGTAAA
TGGTGTCTTTCTTCTGGGGTTTTCAGTTATTGCAAAGAAATGAAGAGATTCTGGAAATGCATCAATAACC
TAAGAAAAAGCGACATAAAAATATACTTATGGCTTGTGTTTATGCTCTTCATCATTGTGCGTTGTGTGCG
```

Figure 20 (Continued)

GTTACCTGCTTGAGTGATCCTGAACTTGTTGCGACAGAGGGACTCACTGGACTCTGTTCGTTATGATTTG
TCTGTTTAAGAGAGAAAACAAAGTGGACTTGATTTTTATTAAGGCTGTTTGTTTTTAAGTGTTGATAGTG
AACGAAAAGATGTGAAGTAATGATATTTTTCTGCTTACAACTTATCCCCACTCATTGGAGTGAACAGTGA
CGCAAGCTCAATAGACTTCATAAGTGTTCATAGAATTTTACAATTCTGAGTGATCTTAGAAATCATTTCT
GTTTTTACAAACAAGGAAACTGAGGTCCAGAAAGAGCAAGCGACTTTGCTTAAAGTCGCATCAGAGAGCT
GAGGGTAAGACTCAGGTGTCCTGACTCCCAGTTTAGTATCTTTTGAATTTTATTTCTGTACCATTTAAAA
AAAATAATTAACACTATTTGTGCAAGTCAGTGTTTTTGAAAATTCAGTGTCCCAATAAAAAGTGGACTGC
ACACTAAAAAAAAAAAAAAAAAAAAAAAAAAAAAAAAAAAAAAAAAAAAAAAAAAAAAAAAAAAAAAAAA
AAAAAAAAAAAAAA

>gi|24308333|ref|NM_032448.1| Homo sapiens family with sequence similarity 120B
(FAM120B), mRNA
GTGAACGAGGCGGCTGTGGCGGTGGCTGAGGCGGCTGGGCCTAGGGTGCAGCGGGCGCGTCTGCGGCTGG
TGTTGGCGCATCTCTAGATCCTTTCCCGGAGTTCAGTTATGGGTGTGAGAGGTTTGCAAGGATTTGTGGG
AAGTACCTGCCCACATATATGTACAGTAGTAAATTTCAAAGAACTGGCAGAGCACCACCGAAGCAAGTAT
CCTGGATGTACCCCTACCATTGTGGTTGATGCCATGTGTTGTCTCAGATATTGGTATACTCCAGAATCTT
GGATCTGCGGTGGCCAGTGGCGAGAATACTTTTCTGCTTTGCGAGATTTGTTAAAACTTTTACGGCAGC
TGGGATCAAGTTGATATTCTTCTTTGATGGCATGGTGGAGCAGGATAAGAGAGATGAATGGGTGAAACGA
AGGCTCAAGAACAACAGGGAGATATCCAGGATTTTTCATTACATCAAGTCACACAAGGAGCAGCCAGGCA
GAAATATGTTCTTCATCCCCTCAGGGCTAGCTGTGTTTACACGATTTGCTCTAAAGACACTGGGCCAGGA
AACTTTGTGTTCTTTGCAGGAAGCAGATTATGAGGTAGCTTCCTATGGCCTCCAGCATAACTGTCTTGGG
ATTCTGGGGAAGACACTGATTACCTAATCTATGACACTTGTCCCTACTTTTCAATTAGCGAGCTCTGCC
TAGAGAGCCTGGACACCGTCATGCTCTGCAGAGAGAAGCTCTGTGAGAGTCTGGGCCTCTGTGTGGCCGA
CCTTCCTCTTCTGGCCTGCCTCCTTGGCAACGACATAATCCCAGAGGGCATGTTTGAAAGCTTTAGGTAC
AAATGCTTATCGTCCTACACCTCTGTAAAAGAGAACTTTGACAAAAAAGGTAACATCATATTAGCTGTGT
CAGACCATATATCGAAAGTTCTTTACTTGTATCAAGGTGAGAAAAAATTAGAAGAGATATTACCTCTGGG
ACCAAACAAAGCTCTTTTTTATAAAGGAATGGCATCATATCTTTTACCAGGACAAAAATCTCCATGGTTT
TTCCAAAAACCCAAAGGTGTAATAACTTTGGACAAACAAGTAATATCCACGAGTTCAGACGCCGAATCCA
GGGAAGAAGTTCCCATGTGTTCAGATGCTGAATCCAGGCAAGAAGTTCCCATGTGTACAGGCCCTGAATC
CAGGCGAGAAGTTCCCGTGTATACAGATTCTGAACCCAGGCAAGAAGTTCCCATGTGTTCAGACCCTGAA
CCCAGGCAAGAAGTTCCCACATGTACAGGCCCTGAATCCAGGCGAGAAGTTCCCATGTGTTCAGACCCTG
AACCCAGGCAAGAAGTTCCCATGTGTACAGGCCCTGAAGCCAGGCAAGAAGTTCCCATGTATACAGACTC
TGAACCCAGGCAAGAAGTTCCCATGTATACAGACTCTGAACCCAGGCAAGAAGTTCCCATGTATACAGGC
TCTGAACCCAGGCAAGAAGTTCCCATGTATACAGGCCCTGAATCCAGGCAAGAAGTTCCCATGTATACAG
GCCCTGAATCCAGGCAAGAAGTTTTAATACGGACAGACCCTGAATCTAGGCAAGAAATTATGTGTACAGG
CCATGAATCCAAACAGGAAGTTCCCATATGTACAGATCCTATATCCAAGCAAGAAGACTCCATGTGTACA
CACGCTGAAATCAATCAAAAATTACCTGTAGCAACAGATTTTGAATTTAAGCTAGAAGCTCTCATGTGTA
CAAACCCTGAAATTAAACAAGAAGACCCCACAAATGTGGGGCCTGAAGTAAAGCAACAAGTAACCATGGT
TTCAGACACTGAAATCTTAAAGGTTGCTAGAACACATCACGTCCAAGCAGAAAGCTACCTGGTGTACAAC
ATCATGAGCAGTGGAGAGATTGAATGCAGCAACACCCTAGAAGATGAGCTTGACCAGGCCTTACCCAGCC
AGGCCTTCATTTACCGTCCCATTCGACAGCGGGTCTACTCACTCTTACTGGAGGACTGTCAAGATGTCAC
CAGCACCTGCCTAGCTGTCAAGGAGTGGTTTGTGTATCCTGGGAACCCACTGAGGCACCCGGACCTCGTC

Figure 20 (Continued)

```
AGGCCGCTGCAGATGACCATTCCAGGGGGAACGCCTAGTTTGAAAATATTATGGCTGAACCAAGAGCCAG
AAATACAGGTTCGGCGCTTGGACACACTCCTAGCCTGTTTCAATCTTTCCTCCTCAAGAGAAGAGCTGCA
GGCTGTCGAAAGCCCATTTCAAGCTTTGTGCTGCCTCTTGATCTACCTCTTTGTCCAGGTGGACACGCTT
TGCCTGGAGGATTTGCATGCGTTTATTGCGCAGGCCTTGTGCCTCCAAGGAAAATCCACCTCGCAGCTTG
TAAATCTACAGCCTGATTACATCAACCCCAGAGCCGTGCAGCTGGGCTCCCTTCTCGTCCGCGGCCTCAC
CACTCTGGTTTTAGTCAACAGCGCATGTGGCTTCCCCTGGAAGACGAGTGATTTCATGCCCTGGAATGTA
TTTGACGGGAAGCTTTTTCATCAGAAGTACTTGCAATCTGAAAAGGGTTATGCTGTGGAGGTTCTTTTAG
AACAAAATAGATCTCGGCTCACCAAATTCCACAACCTGAAGGCAGTCGTCTGCAAGGCCTGCATGAAGGA
GAACAGACGCATCACTGGCCGAGCCCACTGGGGCTCACACCACGCAGGGAGGTGGGGAAGACAGGGCTCC
AGCTACCACAGGACGGGCTCTGGGTATAGCCGTTCCAGTCAGGGACAGCCGTGGAGAGACCAGGGACCAG
GAAGCAGACAGTATGAGCATGACCAGTGGAGAAGGTACTAGTCAACCTCCAGAAAGAGTATGGAGAGAAA
AAGAGGCACACCTGGACGCAGAGCCCTGCCAGCGCCCTCCTCTGCTGTTGCAGCTGCAAGGAGACCATGC
CTGTGGGAGCCAGGCCTCGCTTGCATGAAGAAGGAACGATGCCTTTTTCAATGGTGTCTCCCTCCCATTG
TGCAGAAGAGCTTTTGTTGGCTTCTCTCCCGAGCTTGTGCCTGATTCTGTGGCCCAAAACAATCATTGTT
AACATCTTCATGTGTTTCATTCTGATCTTTCATTCATATATATGATGCCTAGCTAATTTCATTTTAAAAT
AAATGGGAATCTGTTGTATTCTGATTTTTTATTAGCAACACTAGATTATGAGGGGTTATCTCCTGTTATT
AAAAAGTCAGAAAACACTAAAAAAAAAAAAAAAAAAAAAAA

>gi|323510668|ref|NM_032847.2| Homo sapiens chromosome 8 open reading frame 76
(C8orf76), mRNA
CCGCCTTTTCCGGCGGGCCCCGCTTCCTCGTTGCCCCCGCCGCGGGCGCGAGATGGATTCCGGGTGCTGG
TTGTTCGGCGGCGAGTTCGAGGACTCGGTGTTCGAGGAGAGGCCGGAGCGGCGGTCAGGACCGCCCGCGT
CCTACTGCGCCAAGCTCTGCGAGCCGCAGTGGTTTTATGAAGAAACAGAAAGCAGTGATGATGTTGAAGT
GCTGACTCTCAAGAAATTCAAAGGAGACCTGGCCTACAGACGACAAGAGTATCAGAAAGCACTGCAGGAG
TATTCCAGTATCTCTGAAAAATTGTCATCAACCAATTTTGCCATGAAAAGGGATGTCCAGGAAGGTCAGG
CTCGGTGTCTGGCTCACCTGGGTAGGCATATGGAGGCGCTGGAGATTGCTGCAAACTTGGAAAATAAAGC
AACCAACACAGACCATTTAACCACGGTACTCTACCTCCAGCTTGCTATTTGTTCAAGTTTGCAGAACTTG
GAGAAAACAATTTTCTGCCTGCAGAAACTGATTTCTTTGCATCCTTTTAATCCTTGGAACTGGGCAAAT
TGGCAGAGGCTTACCTGAATCTGGGGCCAGCTCTTTCAGCAGCACTTGCGTCATCTCAGAAACAGCACAG
TTTCACCTCAAGTGACAAAACTATCAAATCCTTCTTTCCACACTCAGGAAAAGACTGTCTTTTGTGTTTT
CCTGAAACCTTGCCTGAGAGCTCTTTATTTTCTGTGGAAGCGAATAGCAGTAATAGCCAGAAAAATGAGA
AAGCTCTGACAAATATCCAAAACTGTATGGCAGAAAAGAGAGAAACAGTGTTGATAGAGACTCAGCTGAA
AGCATGTGCCTCTTTTATACGAACCAGGCTTCTGCTTCAGTTTACCCAACCTCAGCAAACATCGTTTGCT
TTGGAGAGGAACTTAAGGACTCAGCAGGAAATTGAAGATAAAATGAAAGGGTTCAGCTTCAAAGAAGACA
CTTTGCTGTTGATAGCTGAGGTTATGGGAGAAGATATCCCAGAAAAAATAAAAGATGAAGTTCACCCAGA
GGTGAAGTGTGTTGGCTCCGTAGCCCTGACTGCCTTGGTGACTGTATCCTCAGAAGAATTTGAAGACAAG
TGGTTCAGAAAGATCAAAGACCATTTCTGTCCATTTGAAAATCAGTTCCATACAGAGATACAAATCTTGG
CTTAGTGGGTTATAAAAAACAAAACCACAAATATCTTGTACTGTATTAATTGTCCTTGTTTACTTCAGAC
AGGATCCATTGCTAATCATGGAGTATAAATGATTATTTATGTTTTATAAAACTGGCTTCTGTCTCAAATG
ATTTCTACTGCAAAAAAAAAA
```

Figure 20 (Continued)

```
>gi|40254993|ref|NM_032855.2| Homo sapiens hematopoietic SH2 domain containing
(HSH2D), mRNA
GTCCTTCCCAAGACCACACCCAGGTCCAGTCATTCCCTAGGACTTGGCAGAGAGCTGTACTCACAGCCAA
GATCACAGCAAAATCAGCAAAGGGAAAAGGCATGCAGAGTGAAGTCCAGAGGCAACCAGACAGAAGCATC
CAGAATCCTCTCACAGTGGGGTCACACACCCCATGCTTAACTCCCCCAACAATGAGTTGTAACAACAGTC
AGGTGTGGTGGTGTGTGCCTGTAGTCCCAGCTACTTGGGAGCCTGAGGCAGGAGGATCACTTGAGTCCAG
CAGTTCAAGACTGCAGTGAGCTATGATCATACCACTGCACTCCAGCCTGAGTGACAGAGTGAGACTCTGT
CTCTAAAATAGGGCTCACCTGCTTGAGGAAACAGGAACTGCCTCGGGGCAGCCAGCCCCGCCCCATTGAC
GTGCAGACCTTGAATCGAAACCCAGGCTCCTGCAGGCACTGGCACAGCTACAGCGAGGGCCTCGGCCATC
CAAGGGTCTCCCAGGTGACCTTCCCTCCACCCCAGGAAGCTATGACAGAGGCCGGGAAGCTGCCCCTACC
GCTACCCCCACGGCTGGACTGGTTTGTGCACACCCAGATGGGCCAGCTGGCCCAAGACGGGGTCCCCGAG
TGGTTCCATGGTGCAATCTCAAGAGAGGATGCTGAGAACTTGCTGGAGTCACAGCCACTGGGATCCTTTC
TCATCAGGGTCAGTCACAGCCATGTGGGCTACACACTCTCCTACAAAGCCCAAAGCAGCTGCTGCCATTT
CATGGTGAAGCTCTTGGATGATGGGACTTTCATGATCCCCGGGGAGAAGGTGGCCCACACCTCGCTGGAC
GCCCTGGTCACCTTCCACCAGCAGAAGCCAATTGAGCCGCGCAGGGAGCTGCTGACACAGCCCTGCAGGC
AGAAGGATCCCGCAAACGTGGATTACGAGGATCTCTTCCTCTACTCCAACGCAGTGGCCGAGGAAGCTGC
CTGCCCGGTGTCTGCCCCTGAGGAGGCCTCCCCAAAGCCAGTCCTGTGTCACCAATCAAAGGAAAGGAAG
CCGTCAGCAGAGATGAACAGAATAACCACCAAGGAAGCCACTTCCTCCTGCCCCCAAAATCCCCTCTTG
GAGAGACCCGCCAGAAACTCTGGAGGAGCCTCAAAATGCTCCCCGAGAGAGGCCAGAGGGTCCGGCAGCA
GCTAAAAAGCCACCTCGCCACTGTGAACTTGTCGTCACTCTTGGATGTCCGGAGATCCACGGTGATCTCA
GGCCCTGGGACCGGAAAAGGCAGCCAAGATCACTCAGGGGATCCCACCTCGGGGGACAGAGGCTACACGG
ATCCCTGTGTGGCCACATCTCTCAAAAGCCCCTCACAGCCCCAGGCACCAAAAGACAGAAAGGTCCCCAC
CAGGAAGGCCGAGAGGTCGGTCAGCTGCATTGAGGTGACCCCAGGGGACAGGAGTTGGCACCAAATGGTA
GTGAGAGCCCTATCCTCCCAGGAGTCCAAGCCAGAGCACCAGGGCTTGGCAGAGCCTGAGAACGACCAGC
TCCCGGAGGAGTACCAACAACCGCCACCCTTTGCCCCTGGGTACTGCTAGAGAACAGGTCCACCCTGGCT
CTGGGACTCGCTGCCAGGGGCTGCCACACTCCTGAATGCCTTAACATTTCTTCCATGGCCCCACACCATG
GCATCCGGGGGTCTTCGGGAACCCGGGAAATGGAATAAAGATGTTTTTGGGGTCTGTTCCTGCACTCACC
CATGGGGTGAGCTGGTTATTTTAGCAACAATCATCAGAGTGACGCTGATGGTTTGGGGCACCAGCTATAC
ATCAGCCCCAGTGCCAGACCTTCTATTCATTATTTTACGCCTCAGAGCAAGGCCCTCAGGGAGGGTCATC
CTCCATGTTTTGAAGAAGAGACTGAGGTTCAGAGAGGATAAGAGGCGTGACCAAGGCCACAGAGCTATGG
GTGTCAGCACCAGGATTTGAAGCCAGGTGAATCCGAGCCCTTTTCCCATATCATCTGTTTGTTCTGTTGT
CTAAAAGCACACTGCAAGCCGGGCTCAGTGGCTCATGCCTGTAGTCCCAGCACTCTGTGGGCCGAGGCA
GGCAGATCGCTTGAGGTCAGGAGTTTGAGACCAGCCTGGCCAACATGGTGAAACCCCGTCTATACTAAAA
AATTCAAAAATTACCCGGACGTGGTGGCGCATGCCTGTAATCCCAGCTACTTGGGAGCCTGAGGCGGGAG
AATTGCTTGAACCCGGGAGGCAGAGGTTGCAGTGAGCCGAGATCGCATCACTGCAGTCCAGCCTGGATGA
CAGAGTGAGACTCCATCTCAAAAAATAAATAAATAAATAAAAATGAAATTAAAAAAAAA >gi|14249589|ref|NM_032858.1| Homo sapiens maelstrom homolog (Drosophila) (MAEL),
mRNA
TTAGGGCGGGAGCCCGGCGAGGGCGCCGGTGCTTTGTTCTGTCTGAGGCCAGGAAGTTTGACCGCGCTGC
CATGCCGAACCGTAAGGCCAGCCGGAATGCTTACTATTTCTTCGTGCAGGAGAAGATCCCCGAACTACGG
CGACGAGGCCTGCCTGTGGCTCGCGTTGCTGATGCCATCCCTTACTGCTCCTCAGACTGGGCGCTTCTGA
```

Figure 20 (Continued)

```
GGGAGGAAGAAAAGGAGAAATACGCAGAAATGGCTCGAGAATGGAGGGCCGCTCAGGGAAAGGACCCTGG
GCCCTCAGAGAAGCAGAAACCTGTTTTCACACCACTGAGGAGGCCAGGCATGCTTGTACCAAAGCAGAAT
GTTTCACCTCCAGATATGTCAGCTTTGTCTTTAAAAGGTGATCAAGCTCTCCTTGGAGGCATTTTTTATT
TTTTGAACATTTTTAGCCATGGCGAGCTACCTCCTCATTGTGAACAGCGCTTCCTCCCTTGTGAAATTGG
CTGTGTTAAGTATTCTCTCCAAGAAGGTATTATGGCAGATTTCCACAGTTTTATAAATCCTGGTGAAATT
CCACGAGGATTTCGATTTCATTGTCAGGCTGCAAGTGATTCTAGTCACAAGATTCCTATTTCAAATTTTG
AACGTGGGCATAACCAAGCAACTGTGTTACAAAACCTTTATAGATTTATTCATCCCAACCCAGGGAACTG
GCCACCTATCTACTGCAAGTCTGATGATAGAACCAGAGTCAACTGGTGTTTGAAGCATATGGCAAAGGCA
TCAGAAATCAGGCAAGATCTACAACTTCTCACTGTAGAGGACCTTGTAGTGGGATCTACCAACAAAAAT
TTCTCAAGGAGCCCTCTAAGACTTGGATTCGAAGCCTCCTAGATGTGGCCATGTGGGATTATTCTAGCAA
CACAAGGTGCAAGTGGCATGAAGAAAATGATATTCTCTTCTGTGCTTTAGCTGTTTGCAAGAAGATTGCG
TACTGCATCAGTAATTCTCTGGCCACTCTCTTTGGAATCCAGCTCACAGAGGCTCATGTACCACTACAAG
ATTATGAGGCCAGCAATAGTGTGACACCCAAAATGGTTGTATTGGATGCAGGGCGTTACCAGAAGCTAAG
GGTTGGGAGTTCAGGATTCTCTCATTTCAACTCTTCTAATGAGGAACAAAGATCAAACACACCCATTGGT
GACTACCCATCTAGGGCAAAAATTTCTGGCCAAAACAGCAGCGTTCGGGGAAGAGGAATTACCCGCTTAC
TAGAGAGCATTTCCAATTCTTCCAGCAATATCCACAAATTCTCCAACTGTGACACTTCACTCTCACCTTA
CATGTCCCAAAAAGATGGATACAAATCTTTCTCTTCCTTATCTTAATGATGGTACTCTTTTCAATTTCTG
AAAACAGTAACAGGCCCAACTTCCTTCTTACTACAGTCATATTAAACAGATCACATCAATGACAAATGTC
ACTACTATAAAAACTACTTAATTTGTAAGGAAATTGTTTCATAGATTTAAAAAAATTGTGGTTGGAGAGC
ATCTTGGCATTTGTGCTTTTTTTCTTGAGGGATTGTTCTGCTTCCTGGCTGTATGATGGGTATATCATTA
AAGTTTGGAGTCCTATATGAACAAAACTGACATTTTTAGAGTTGTACTTTTGGGAATGTTATAGATTGAT
CATTCTTTCTCCTGATAATAAAGGTATTGAATATCTGTTATGAAAGGTTCT

>gi|111494228|ref|NM_032906.3| Homo sapiens phosphatidylinositol glycan anchor
biosynthesis, class Y (PIGY), nuclear gene encoding mitochondrial protein,
transcript variant 1, mRNA
ACCAGGGGCGGGGCCTGCCCGGCTGGCCTGGACGAACGGGAAGCCGGGAGCTCGGCCACGGGTGGCGAG
GCTGCGGTGAGGCCTGGTCTCCGGCTGCCAGACCATGCTGAGTGGAGCACGCTGCAGGCTCGCCTCAGCG
CTGCGGGAACGCGCGCGCCGCCGTCCGCGGTCGCCCGTAGGTGCCTGCACGCGTCGGGGTCGCGGCCTT
TGGCCGACCGGGGCAAGAAGACTGAGGAGCCGCCCCGCGACTTCGATCCGGCGCTGCTGGAGTTCCTGGT
GTGCCCGCTCTCCAAGAAGCCGCTCAGATATGAAGCATCAACAAACGAATTGATTAATGAAGAGTTGGGA
ATAGCTTATCCAATCATTGATGGGATCCCTAATATGATACCACAGGCAGCTAGGATGACACGTCAAAGTA
AGAAGCAAGAAGAAGTGGAGCAGCGCTAGTTCATAATTTAAAAAAATTAAAAAAACGCAACAGCCAACTT
TTCTTAATACCATATACCTTTTAAAACACAGTGGCAGGTAATAAGTGGAAGAGAAGAATGTTTCTGTCTC
TTCCTACGTTGACTGTTCTTATTCCACTGGTTTCTTTAGCAGGACTGTTCTACTCAGCCTCTGTGGAAGA
AAACTTCCCACAGGGCTGCACTAGCACAGCCAGCCTTTGCTTTTACAGCCTGCTCTTGCCTATTACCATA
CCAGTGTATGTATTCTTCCACCTTTGGACTTGGATGGGTATTAAACTCTTCAGGCATAATTGATGCAACT
AGAGTCAATATGCTGTATATATTAATGATAGCTCTTGGGCATCGATCTCTGAAAGCTCAAATGGATGGAA
TTTAGTTTGCGGGAAAGAGGCTTTGCTTTGCGCATATCAGGCTTAGGACTGTGGGAGGCTTAAGTTGCAG
ATGCTTCTTTTATTGTACTCTTGTTCTGCCCTTGTTTTTGAAGGCTCTGACTTATAACTGCTGTATCAG
AAGAAACATTTTGACAGTGTCTTGGTTGGAGATGAACATCCCTAATTGACATGTGATGACTATTTCTTAT
TCCATTCATCTAAGAGTCATTGAAATTTTGTTTTGCTTGTTTGTTTAGCTTCAAGGTCTTTGGTAAAGTC
```

Figure 20 (Continued)

ACATGTTAAGGATGACTGAAATAATTCCAAAGGAGTGATGTTGGAATAGTCCCTCTAAGGGAGAGAAATG
CATTTGAACGAATGTGATATAAAACCACATAATCAAATAGAAACTTCATGTACTTACAAAAACTGAGTTT
GTAAAATTACCTTCATTTCTTTGACATTAAATGCTTATATTAGCAATAAACATGTTGACACTTTCCTATA
AAAAATAAACCAGTTTGCAGTAG

>gi|88758609|ref|NM_033310.2| Homo sapiens potassium channel, subfamily K, member 4 (KCNK4), mRNA
AGGCTGTCCCCAGGGGCGGAGAGTTGCGGACCCTTCCCGATCCGGTAATGGGCCTGGGAGATGCCAGATT
AGCGTGGTGCCTGTCCGGAGAGACGGGCCAGCTGATGCCCAGGTCGGGGCCCTGCCGCTGGCCACACTGG
GCTCCGGTCCAAGGCTAGAAGGCTGGCCCCTGCTGCAACCCCTCTCCGGCTCCTCTGCCACCCACCTCCC
GGGGCTGGCCGGCTGTGGGGAGCCAGGCGGCCGCAGTGACGACAGCTCCCCAGGAGCCCCCGCCGGCC
CCTCCAGGCGGGCAGTGGAGCTGGCCCGGCGCCTGGGCGCGCCATGCGCAGCACCACGCTCCTGGCCCTG
CTGGCGCTGGTCTTGCTTTACTTGGTGTCTGGTGCCCTGGTGTTCCGGGCCCTGGAGCAGCCCACGAGC
AGCAGGCCCAGAGGGAGCTGGGGGAGGTCCGAGAGAAGTTCCTGAGGGCCCATCCGTGTGTGAGCGACCA
GGAGCTGGGCCTCCTCATCAAGGAGGTGGCTGATGCCCTGGGAGGGGGTGCGGACCCAGAAACCAACTCG
ACCAGCAACAGCAGCCACTCAGCCTGGGACCTGGGCAGCGCCTTCTTTTTCTCAGGGACCATCATCACCA
CCATCGGCTATGGCAATGTGGCCCTGCGCACAGATGCCGGGCGCCTCTTCTGCATCTTTTATGCGCTGGT
GGGGATTCCGCTGTTTGGGATCCTACTGGCAGGGGTCGGGGACCGGCTGGGCTCCTCCCTGCGCCATGGC
ATCGGTCACATTGAAGCCATCTTCTTGAAGTGGCACGTGCCACCGGAGCTAGTAAGAGTGCTGTCGGCGA
TGCTTTTCCTGCTGATCGGCTGCCTGCTCTTTGTCCTCACGCCCACGTTCGTGTTCTGCTATATGGAGGA
CTGGAGCAAGCTGGAGGCCATCTACTTTGTCATAGTGACGCTTACCACCGTGGGCTTTGGCGACTATGTG
GCCGGCGCGGACCCCAGGCAGGACTCCCCGGCCTATCAGCCGCTGGTGTGGTTCTGGATCCTGCTCGGCC
TGGCTTACTTCGCCTCAGTGCTCACCACCATCGGGAACTGGCTGCAGTAGTGTCCCGCCGCACTCGGGC
AGAGATGGGCGGCCTCACGGCTCAGGCTGCCAGCTGGACTGGCACGGTGACAGCGCGCGTGACCCAGCGA
GCCGGGCCCGCCGCCCCGCCGCCGGAGAAGGAGCAGCCACTGCTGCCTCCACCGCCCTGTCCAGCGCAGC
CGCTGGGCAGGCCCCGATCCCCTTCGCCCCCCGAGAAGGCTCAGCCGCCTTCCCCGCCCACGGCCTCGGC
CCTGGATTATCCCAGCGAGAACCTGGCCTTCATCGACGAGTCCTCGGATACGCAGAGCGAGCGCGGCTGC
CCGCTGCCCCGCGCGCCGAGAGGTCGCCGCCGCCCAAATCCCCCAGGAAGCCCGTGCGGCCCCGCGGCC
CCGGGCGTCCCCGAGACAAAGGCGTGCCGGTGTAGGGGCAGGATCCCTGGCCGGGCCTCTCAAGGGCTTC
GTTTCTGCTCTCCCCGGCATGCCTGGCTTGTTTGACCAAAGAGCCCTCTTTCCACGAGACTGAAGTCTGG
GGAGGAGGCTACAGTTGCCTCTCCGCCTCCTCCCTGGCCCCGGCCCTTCCCTCACTTCCATCCATCTCTA
GACCCCCCAAGGCTTTCTGTGTCGCTGCCCCGGGCGGGTGTATCCCTCACAGCACCTCACGACTGTGCC
TCAAAGCCTGCATCAATAAATGAAAACGGTCTGCACCGCTGCGGGCGTGACGCTCCCGGAAAAAAAAAAA >gi|134244283|ref|NM_033316.3| Homo sapiens antigen p97 (melanoma associated) identified by monoclonal antibodies 133.2 and 96.5 (MFI2), transcript variant 2, mRNA
ACTTAAGGAGCTCGGGCCAGCGCGAGGGGAGCAGGGAGGAAGCCCGGCTGCTGCGGACCTCCTCGGACC
CGGACCCAGCCCCAGCCCGGCCCCAGCCAGCCCCGACGGCGCCATGCGGGGTCCGAGCGGGGCTCTGTGG
CTGCTCCTGGCTCTGCGCACCGTGCTCGGTGGCATGGAGGTGCGGTGGTGCGCCACCTCGGACCCAGAGC
AGCACAAGTGCGGCAACATGAGCGAGGCCTTCCGGGAAGCGGGCATCCAGCCCTCCCTCCTCTGCGTCCG
GGGCACCTCCGCCGACCACTGCGTCCAGCTCATCGCGGCCCAGGAGGCTGACGCCATCACTCTGGATGGA

Figure 20 (Continued)

```
GGAGCCATCTATGAGGCGGGAAAGGAGCACGGCCTGAAGCCGGTGGTGGGCGAAGTGTACGATCAAGAGG
TCGGTACCTCCTATTACGCCGTGGCTGTGGTCAGGAGGAGCTCCCATGTGACCATTGACACCCTGAAAGG
CGTGAAGTCCTGCCACACGGGCATCAATCGCACAGTGGGCTGGAACGTGCCCGTGGGCTACCTGGTGGAG
AGCGGCCGCCTCTCGGTGATGGGCTGCGATGTACTCAAAGCTGTCAGCGACTATTTTGGGGGCAGCTGCG
TCCCGGGGGCAGGAGAGACCAGTTACTCTGAGTCCCTCTGTCGCCTCTGCAGGGGTGACAGCTCTGGGGA
AGGGGTGTGTGACAAGAGCCCCCTGGAGAGATACTACGACTACAGCGGGGCCTTCCGGTGCCTGGCGGAA
GGGGCAGGGGACGTGGCTTTTGTGAAGCACAGCACGGTACTGGAGAACACGGATGAAAGTCCATCACGAA
GGCAAACATGGACCAGATCTGAGGAGGAAGAAGGCGAGTGCCCTGCACACGAGGAAGCACGTAGGACGAT
GCGCTCTAGTGCTGGGCAAGCCTGGAAATGGGCTCCCGTTCACAGGCCCCAGGACGAGTCTGACAAAGGA
GAATTTGGAAAACGGGCAAAGAGTAGGGATATGTTGGGTTAAGAATCAGCTCTTTCAAACTTGGGGTTTT
TTTTGAGATGGGGGTCTCACCATGTTGCCCAGGCTGGTCTCAAACCCCCAGCCTCAACTGATCCTCGCAT
CTCAGCCTCCTGAGTAGCTGGGATGACAGGCGTGCACCTGGCAGCTTTTTCAAAGTGTTGATGGTAATCT
GAGGCAATCTAAGGGAGTCATTTTTTAAGTGACTTTATACAGAAAGATTGGTAAGAGCCAAGGGGTAGAA
GTGGCATAAATGTCTAAAGCAGGGAAGTGACAGGACTTTCATTGTTCTTGGCTGAGGAGAAGCGGGAGTG
GCTGATGGAAGCACCTAAATGATGCCTTTGTCTGTGGGAAGGCAAATGATGCCCCAGAGCTCTAACCAAA
GGTTTTGCAGCCGCCGAAAAACAGGAAAGTTGGGAAGCGGGGTAGGACTACACTGAATCATTAACAGTG
CTGTAAACTACCATGTGGCCATTAACAATGACCTTTAGGGAGTTTTCCTAAACGATCACTCTGGTGCGGG
TGTTTGGTTTTGTTTTAAAATAGCTTTGCAGTGAAAGCTTTCATGACCATACAAATTATCTTTTTTCTTC
CTATTTCCTTGTAGAGGTTTTTTTCCTCCTTGTCTTAAGGTCATAAAAATATTGTTATGTGGGAAAAAAA
AAAAAAAAAAAAAAA

>gi|23510343|ref|NM_033421.2| Homo sapiens sorting nexin family member 21
(SNX21), transcript variant 1, mRNA
TGAGCCCGGCGGAGCCCTGCAGAACCCGGCCGACCTCCATGGGCTGCGGGGGCTGCACCCGGACCCCTG
GGGCGCGGCGCGCCCCTGAATGCACCGTGGGACGCAGGAGGGTGCCATGGCCTCCCGGCTCCTGCACCGG
CTGCGGCACGCCTTGGCCGGCGACGGCCCCGGGAGGCGGCGGCCAGTCCAGAGGCCGAGCAGTTTCCGG
AGAGCTCAGAGCTGGAGGACGACGACGCCGAGGGCCTGTCCTCCCGACTCAGCGGCACCCTCAGCTTCAC
CAGCGCCGAGGACGACGAGGACGACGAGGACGAGGACGACGAGGAGGCTGGCCCTGACCAGCTGCCCCTC
GGGGATGGGACGTCAGGAGAAGACGCAGAACGGAGCCCCCCACCTGATGGGCAGTGGGGCAGTCAGCTCC
TGGCGCGGCAGCTGCAGGATTTCTGGAAGAAGTCCCGGAACACCTTGGCACCCCAGCGGCTGCTCTTCGA
AGTGACCAGCGCTAACGTTGTCAAGGACCCGCCCTCCAAGTACGTGCTCTACACCCTCGCCGTGATCGGC
CCAGGACCGCCAGATTGCCAGCCAGCCCAGATCTCTCGCCGTTACTCGGACTTTGAGCGGCTGCACCGAA
ACCTGCAGCGGCAATTCCGGGGCCCAATGGCTGCCATCTCCTTCCCCCGTAAGCGGCTGCGCCGGAATTT
TACTGCAGAGACCATTGCCCGCCGTAGCCGGGCCTTTGAGCAGTTTTTGGGTCACCTGCAGGCAGTGCCT
GAGCTGCGCCATGCCCCGGACCTGCAGGACTTCTTCGTGCTGCCGGAGCTGCGGCGGGCACAGAGCCTCA
CCTGTACTGGCCTCTATCGTGAGGCTCTGGCACTCTGGGCCAATGCCTGGCAGCTGCAAGCCCAGCTGGG
CACCCCCTCTGGCCCAGACCGCCCCCTGCTGACCCTGGCTGGGCTGGCCGTGTGCCACCAGGAGCTGGAA
GACCCTGGAGAGGCCCGGGCATGCTGTGAGAAGGCCCTGCAGCTGCTTGGGGACAAGAGCCTCCACCCTT
TGCTGGCACCCTTTCTGGAGGCCCATGTCCGGCTCTCCTGGCGCCTGGGCCTGGACAAACGTCAATCAGA
GGCTCGGCTCCAAGCCCTGCAGGAGGCAGGCCTTACCCCACACCACCCCCCAGTCTCAAAGAATTGCTC
ATCAAGGAGGTGCTGGACTAACCCTTGCCTAGATTTAAGGCCACTGTGAGGAGAGGGGTTGCCCCAGAAG
GCAGGGGAAGGACCTGATGAGAACAGAATAGCTGGGAGGCTGCAGAGGGTGCTGGGAGCCCCTAGAAGTT
```

Figure 20 (Continued)

```
CCAAAAGAGAATGTGAAGCAGATCAAGGAAACTTCTGTTGAGCTAGGCTCAGGGTGAGCTTTGGCTGGGG
TTGCCCTTGTGTAGTACAGGGAAGTCTGACACAGCCTCTCCAGCCTATAAACAGCCGGGGGGCTGTGGCA
CAGGTTGGGGCAATGTTCCCTTGTTGGTGGGCCCCAAGCTGGCAAGGCCTCTTGGCTGAAGGCCAGGGA
CTCTGCCCCTGGAGTCCTGGAGTTAAGGGATGAAGGCAAGGCTGCAGGTCTGGCCCAGGGGAATTAAAAG
CCAGCCACTCCAGTGGTATCAGTCTCTTTATTGGATGTGAGGGCCAAAAGGGACTGTAACTCCTGTCTCA
GGAATGGGATAGATGGGAGGTTCTTGAAGCCCCAGGCGAAGCTGGTACCTCTGGCTACAGCTTGCTCTC
TGAGACCTGGGGCTTCACTCGGATCACGCCCTCCTGGGCACAGGTCACAGCTAGGACTCCATCCTGACGC
CACAGCCGCCCATGGACCAGCCCCCGAGAGCCACCTGTGGGTGAGGTGAAGGGTGATGATGGCCTGCTTC
AGAACAGCCAAATACACTTTTTTTTTTTTCCTGAAACAGAGTCTCACTAAGTTGCCAGGCTGGTCTCAA
GCGCCTGGGTTCAAGGGATCCTCCCGCCTCAGCCTCCTGAGCAGCTGGGATTACAGGCGCACATCACCAT
GCCCAACCTCCAAGTGGACTTCTTGCAAAGGGTCTGGCCCAGGGCAGGGCTGCCCCACACAAGGGTGCAC
TGAGTGTCGTGGCTGCTCCAAATGCCCCTTCATGAGCTTATTATGGACCGTCATTGAGGGGTAACTCCTC
CCACAGGAACCCCAGTTGACAGTTTAAAAGCACTTTCACACCTCTCCTCGCTTCCTCAAAAAGATCACAG
AGGGAGGAGCTCTGAGAACAGTCTCCTTCAACAGTTCGGCCAAGCAGAACTGCTGTACCTCTGACCACTT
GTGTTAGGAAAACTATCGGCTCCCTGTATAATAAATCAAGCCAGGTCCTCCAAGTGGTAATTCATGAAAA
ATATCCCCACTACCACCACCAAGGGGAAGAAAGGACTCAGAAGAGAGGACTTGAGGCCATGAGGTCTGGC
CTCTTCCCTCCCCATCTGGAGACTCTTTCTCCCTTGCTGGCTTTGGGCCCAAGTTTGATGTTTATGAGGA
TGATTGCTGGTTTCCCTTACACATAGCAGAGCTCACTCAGTTCTCACAGTAGCCAAATGAAGCAGTTATG
TGTTGTCCAGTTTTCCAGACCAGGACTGAAATCCAGAGAGGGTCAGGAATTTGGCCCCATGATGAAGCCA
AATCTGAACCCATGTCCTCACTTCAAGGTTATCAATCTTGGATTGTGATGCTATTGGTACTTGAGAATAC
CCCTTATCTGAGTATAAAGAATCCTTGAGTTTTGTCCTTGGTTTATCAAGCAAAGCTTTTCTTCATTTGA
AATGTACTCCCTTGGAAAGGAGGTCAGGGTTCTGAAGCTAGACATTGATGAACGAGTCTTGTTTCTCTCC
CCTGCAAGGAAGGTCCAAGCAGGCCCTTAGGGACCACTGAATGCCCCGATCCCAATCAGGTTAATCAGAA
TCACTTAGAGAACTTAAAAATACAGTTTCCTGGACCTTATCCAAGACCTACTGAGTGAGAATCTTGAGGG
TGGAATCAGAATCTATTTTGAAAAGGCATCCCCAAATGGCAGTCTGATGGACTGCGGGTTTGGATACCAC
TGCTGTAATGTAACCCTCTTTGTTTAGATGAGGAAACTGAGGTTCAGATGGAAGATATGATTTGCCTATT
GTAATACAAAGAATCTGAACTGG

>gi|50086623|ref|NM_033547.3| Homo sapiens integrator complex subunit 4 (INTS4),
mRNA
CGGAAGCTGAGAGGGCCCGCGGGTAGGCATGGCGGCGCACCTTAAGAAGCGGGTTTATGAGGAATTCACG
AAAGTGGTTCAGCCACAGGAGGAAATTGCTACTAAGAAACTCCGACTAACAAAACCAAGTAAATCTGCAG
CACTCCACATAGATCTGTGTAAAGCTACCTCCCAGCAGATGCTTTGCAATACTTGCTCCAGTTTGCCAG
GAAGCCTGTCGAGGCGGAAAGCGTAGAGGGAGTAGTCAGGATTCTCTTGGAACATTATTACAAGGAGAAT
GATCCATCTGTGAGACTGAAAATTGCATCATTGTTGGGTTTATTATCAAAGACAGCAGGATTTTCACCAG
ACTGCATTATGGATGATGCCATCAACATCCTGCAGAATGAAAAGTCTCATCAAGTCCTAGCTCAACTGCT
GGATACTTTGCTTGCAATTGGCACTAAGCTACCAGAGAATCAAGCTATCCAAATGCGATTAGTTGATGTG
GCCTGCAAGCATCTGACAGATACGTCTCATGGTGTAAGAAATAAGTGCCTGCAGTTACTTGGCAATCTTG
GCTCTTTGGAGAAAAGTGTCACAAAAGATGCAGAAGGCCTAGCTGCCAGAGATGTCCAGAAGATTATAGG
GGATTACTTCAGTGACCAAGACCCACGTGTCAGAACAGCAGCTATAAAAGCCATGTTGCAGCTCCATGAA
AGAGGACTGAAATTACACCAAACAATTTATAATCAGGCCTGTAAATTACTCTCTGATGACTATGAACAAG
TGCGCAGTGCTGCAGTCCAGCTTATCTGGGTCGTCAGTCAGCTCTATCCTGAAAGCATTGTCCCAATTCC
```

Figure 20 (Continued)

```
TTCTTCTAATGAAGAAATACGCTTAGTTGATGATGCGTTTGGCAAAATTTGTCACATGGTCAGTGATGGC
TCTTGGGTGGTTCGTGTTCAGGCAGCAAAACTGTTGGGCTCTATGGAGCAAGTCAGTTCTCATTTCTTGG
AGCAGACCCTTGACAAGAAGCTGATGTCAGATCTGAGGAGGAAACGTACTGCACATGAGCGTGCCAAGGA
ACTTTACAGTTCGGGGGAGTTTTCCAGTGGCAGAAAGTGGGGAGATGATGCTCCCAAGGAAGAAGTAGAT
ACCGGGGCTGTGAACTTGATTGAGTCAGGAGCTTGTGGAGCTTTTGTTCATGGGTTGGAAGATGAGATGT
ATGAGGTTCGTATTGCTGCTGTGGAGGCCCTCTGCATGTTGGCCCAGTCTTCACCCTCTTTTGCTGAGAA
GTGCCTTGATTTCCTAGTTGACATGTTCAACGATGAAATTGAGGAAGTACGTCTGCAGTCTATACATACC
ATGAGAAAAATCTCTAACAACATCACCCTCCGAGAAGATCAGCTTGACACTGTCCTGGCTGTGCTAGAGG
ATTCATCCAGAGATATTCGAGAGGCTCTTCATGAACTCTTATGCTGTACTAATGTTTCAACCAAAGAAGG
GATTCATCTTGCATTGGTGGAGCTGCTGAAAAATTTAACCAAGTACCCTACTGATAGGGACTCCATATGG
AAGTGCTTGAAGTTTCTGGGAAGTCGGCATCCAACCCTGGTGCTTCCCTTGGTGCCAGAGCTTCTGAGCA
CCCACCCATTTTTTGACACAGCTGAACCAGACATGGATGATCCAGCTTATATTGCAGTTTTGGTACTTAT
TTTCAATGCTGCTAAAACCTGTCCAACAATGCCAGCATTGTTCTCAGATCACACCTTCAGGCACTATGCC
TACCTCCGAGACAGTCTTTCTCATCTTGTTCCTGCCTTGAGGTTACCAGGTAGAAAACTGGTGTCATCAG
CTGTTTCTCCCAGCATCATACCTCAAGAGGATCCTTCCCAGCAGTTCCTGCAGCAGAGCCTTGAAAGAGT
GTATAGTCTTCAGCACTTGGACCCTCAGGGAGCCCAGGAGCTGCTGGAATTCACCATCAGGGATCTGCAA
AGACTTGGAGAACTTCAATCTGAATTGGCAGGAGTAGCTGATTTCTCTGCCACCTATCTTCGCTGTCAAC
TACTTCTCATCAAGGCCTTGCAGGAAAAGTTGTGGAATGTAGCTGCCCCTTTGTATTTGAAGCAGAGTGA
TTTGGCCTCAGCAGCAGCGAAACAGATTATGGAAGAGACCTACAAAATGGAATTCATGTACAGTGGTGTG
GAGAATAAGCAGGTGGTGATTATACATCACATGAGGCTGCAGGCCAAAGCTTTGCAACTTATAGTAACAG
CACGAACTACACGAGGACTTGACCCCTTATTTGGGATGTGTGAAAAATTTTTACAGGAAGTAGACTTTTT
TCAGAGGTATTTCATCGCTGATTTGCCCCACTTGCAGGACAGCTTTGTGGACAAACTCCTTGACCTTATG
CCCCGACTCATGACATCCAAACCTGCAGAAGTGGTCAAAATTCTACAGACCATGCTGCGACAGAGTGCCT
TTCTGCATCTCCCGCTTCCAGAGCAGATCCACAAAGCCTCAGCCACCATCATCGAGCCAGCGGGCGAGTC
AGACAACCCTTTGCGGTTTACCTCTGGGTTGGTGGTTGCCCTGGATGTTGATGCAACCCTGGAGCATGTG
CAGGATCCTCAGAACACTGTTAAGGTCCAGGTCTTATATCCAGATGGCCAGGCTCAGATGATTCACCCCA
AGCCTGCAGACTTCCGGAATCCTGGCCCAGGGCGGCACCGGCTCATCACTCAGGTTTATCTCTCCCACAC
CGCTTGGACAGAGGCATGCCAGGTGGAAGTGAGGCTGCTGCTGGCCTACAACTCCAGTGCTCGCATTCCA
AAATGCCCCTGGATGGAGGGTGGTGAGATGTCACCACAGGTGGAAACCAGCATCGAGGGCACCATTCCCT
TCAGCAAGCCTGTAAAAGTTTATATAATGCCCAAACCTGCACGGCGCTAAGGCAAAAACAGTCTTCCCAA
CCGTGGCCTAGAGGGCCCTTCTTAGGTGTCAGAATGAGCCAAGCCTGAAGCACTTCACCTGGAATTGATG
TGTAGGCTTAAGGAGTATGTGACCCTTACAGTCTCATCTGGTATCAAACACAGGATAAATTGTTTCTTCA
TTAAAAAATAAAAAACCTTCAAGTCTACTTACCCTTCTCCTGTCCACAATAAAGTTGAGAAAACACCAAA
AAAAAAAAAAAA

>gi|40217837|ref|NM_033661.3| Homo sapiens WD repeat domain 4 (WDR4), transcript
variant 2, mRNA
GCGTCACCGACCGGTGCGGACAGGAAGAGGCTCTGGGCTGGCACATGTGTATGGCGGTGAGGCGGGCGGG
TACATGGCGGGCTCTGTGGGACTGGCGTTGTGCGGGCAGACGTTGGTGGTGCGGGGCGGCAGCCGATTCC
TGGCCACCTCCATAGCAAGCAGTGATGATGACAGCCTCTTCATCTATGACTGCAGTGCTGCAGAAAAGAA
GTCACAAGAAAATAAAGGGGAGGACGCGCCCTTGGACCAGGGGAGCGGTGCGATTCTGGCGTCCACCTTC
TCCAAGTCTGGCAGCTATTTTGCTTTAACCGATGACAGTAAGCGTCTGATTCTTTTCCGTACAAAACCAT
```

Figure 20 (Continued)

```
GGCAATGTCTGAGTGTCAGGACCGTGGCAAGGAGGTGTACAGCCCTGACTTTCATAGCCTCGGAGGAGAA
GGTCTTGGTGGCCGACAAGTCTGGAGACGTCTACTCCTTTTCGGTGCTGGAGCCACACGGGTGTGGCCGT
CTAGAGCTGGGGCACCTGTCTATGCTGTTAGATGTGGCTGTGAGTCCTGATGACCGCTTCATCCTCACTG
CCGACCGGGACGAGAAGATCCGAGTCAGCTGGGCCGCGGCGCCCCATAGCATCGAGTCCTTCTGCTTGGG
GCACACAGAGTTTGTGAGCCGTATCTCCGTGGTGCCAACTCAGCCCGGGCTGCTTCTGTCCTCCTCTGGG
GACGGCACCCTGAGGCTCTGGGAGTACAGGAGCGGCCGCCAGCTGCACTGCTGTCACCTGGCCAGTCTGC
AGGAGCTGGTGGACCCCCAGGCCCCCCAGAAGTTTGCCGCGTCCAGGATTGCATTCTGGTGCCAGGAGAA
CTGCGTGGCGCTCCTGTGCGACGGCACTCCTGTGGTCTACATCTTCCAGCTGGACGCCCGCAGACAGCAG
TTGGTGTACAGGCAGCAGCTGGCGTTCCAGCACCAAGTGTGGGACGTGGCTTTCGAGGAGACCCAGGGGC
TGTGGGTGCTCCAGGACTGCCAGGAAGCCCCCTGGTGCTCTACAGGCCTGTGGGCGACCAGTGGCAGTC
TGTTCCTGAGAGCACCGTGTTAAAGAAAGTCTCTGGTGTTCTTCGTGGGAACTGGGCCATGCTGGAAGGC
TCTGCCGGCGCAGACGCCAGCTTCAGCAGTCTCTACAAGGCCACGTTCGACAACGTGACCTCCTACCTGA
AGAAGAAAGAGGAGAGACTGCAGCAGCAGCTAGAGAAGAAGCAGCGGCGCCGGAGTCCCCCGCCTGGGCC
CGACGGGCATGCCAAGAAGATGAGACCGGGGAGGCGACGCTAAGTTGCTGATCGTGGCGGTCTGTTTCT
GTCGACTGTGGACCACTTATGTGCGATCCGTGGACCACTTGCGTGCGATCTGTCGGCCGACGATGAGCTT
GTTCGGATGTAGCTCCATCGTAAGTCGAGGAGCATCTGTGATTTGTCCTCTGCTTATGGGATATGTTTTT
CCGCTACTGAGTCTGTGTAGTAAATTTTTGACTAGGAAAAAAAAAAAAAAAAAA

>gi|37577120|ref|NM_080387.4| Homo sapiens C-type lectin domain family 4, member
D (CLEC4D), mRNA
CTTTGAAAAGACTTCTTTTGAGCTAACTTTCTTATACTGGTACCTTTCTAATCTCACTACAATATGTAA
CATTGGTGTTCGATCTCAAGTATTTCTGAATATATTCCCCTATCCACAGAAATATACTCTGGGGGAAAAA
AAATAGAACAAATTCTTGCCGTCCTGACCATTGAACAAGAGACTAATTAGACAATGGGGCTAGAAAAACC
TCAAAGTAAACTGGAAGGAGGCATGCATCCCCAGCTGATACCTTCGGTTATTGCTGTAGTTTTCATCTTA
CTTCTCAGTGTCTGTTTTATTGCAAGTTGTTTGGTGACTCATCACAACTTTTCACGCTGTAAGAGAGGCA
CAGGAGTGCACAAGTTAGAGCACCATGCAAAGCTCAAATGCATCAAAGAGAAATCAGAACTGAAAAGTGC
TGAAGGGAGCACCTGGAACTGTTGTCCTATTGACTGGAGAGCCTTCCAGTCCAACTGCTATTTTCCTCTT
ACTGACAACAAGACGTGGGCTGAGAGTGAAAGGAACTGTTCAGGGATGGGGGCCCATCTGATGACCATCA
GCACGGAAGCTGAGCAGAACTTTATTATTCAGTTTCTGGATAGACGGCTTTCCTATTTCCTTGGACTTAG
AGATGAGAATGCCAAAGGTCAGTGGCGTTGGGTGGACCAGACGCCATTTAACCCACGCAGAGTATTCTGG
CATAAGAATGAACCCGACAACTCTCAGGGAGAAAACTGTGTTGTTCTTGTTTATAACCAAGATAAATGGG
CCTGGAATGATGTTCCTTGTAACTTTGAAGCAAGTAGGATTTGTAAAATACCTGGAACAACATTGAACTA
GAAACTCAGAAAGTGGTCCTTGTGATGGAAAGAGAAAAGAAAAACCAATTAGAATAAGGCAGAATGTACG
TGCGTCATTGGAACACAGAAAACATGCTGGTTCATACAGCGTTTTTAGTCATAATGGTCTTTTTTATTTT
GTTTGATTCATTCGAGACAACATGTGTGTATGTGTGTGTGTGTGTGTAGATAATGTGGTTTTTGTATG
GTGTTTGATGGAAGGAATAATCTTTCTTTGCTTTCTTAGTAGTATTTCAAGGTGTTTACTTTTCAATTGG
TGTGCACTGAATGCATGTATGGAAGAATAGCGTGAATAATGCAATCTCTTTGTCATTTTTCCCCTTCTCA
GACTCTTAGCTCTTAAAATTCAAAGATGGGATATTCTAACTGGTAGTGGTGCATCATTTTTAACCCAAAT
ATTGCAAGCACTTTAAAGATTTGAAACCACATTTTTATTGTTTGATGTTTCATTTTCAGACTTTTTAATG
TCAGTCATTACAATTACATTGCATGAGGAAAATTTTTCCAGAACAACAGTGTGGAATAGTTCTGAATTAT
GCTGTTCTACAGATAGAAAAAAAGTCCAAATGCCTTTAAAAATTTACTTCTTACTCCACCCAACACGTTT
TTGCAAAGCAAGAAGTCTTTGTAAGACACCTTAAACAAAGTCCTTCAATTCTACAGCAGAGGAAATAAAA
```

Figure 20 (Continued)

```
TCCCCCAGAAGCCAAAGGGCTCACCTTCACATTGTTAGTTCATGACAGACCCAGGTGTGCTTCATTAGAG
ATAACATACATTCCCTTTGGTATCACAGGAAGTTACTGGGGATTACTCGACCTCATTACTTAGCTAACGA
CTGGATAAAATTTCTTAATTGTTTGAAGTAACATTGTATTCGTGTTTGCATTATTAATTTGAATAGAAAA
TAATCACATTTTCAACCCATTTATACAAATTGTTAATGTTTCTTTAGAGCTGTATAACTATAGTTTGAAC
TAGCAAGGAAGTTATTGTTTTGACAACCAGAAATTATGCTTTTCTGGTGCATGAAACATTAATTGCAAAG
GGCAGTCACATCCAACTTTAATAAAATATGGTGGTCTTTCTTAAAAAAAAAAAAAAAAAAAAAAAAAAAA
AAAAAAAAAAAAA
```

>gi|213972613|ref|NM_080650.3| Homo sapiens ATP binding domain 4 (ATPBD4), transcript variant 1, mRNA
```
GCTGCGGCGCGACCTCCTGGCTCCCGCCCGCGCTCGCCGCACGCACGCGCACTGCGCCCAGCATGAGGGT
CGCGGCTCTGATCAGTGGTGGGAAGGACAGCTGCTATAATATGATGCAGTGCATTGCTGCTGGGCATCAG
ATCGTTGCTTTAGCAAATCTAAGACCAGCTGAAAACCAAGTGGGGTCTGATGAACTGGATAGCTACATGT
ATCAGACAGTGGGGCACCATGCCATTGACTTGTATGCAGAAGCAATGGCTCTTCCCCTCTATCGCCGAAC
CATAAGAGGAAGGAGCTTGGATACAAGACAAGTGTACACCAAATGTGAAGGTGATGAGGTTGAAGATCTC
TATGAGCTTTTGAAACTTGTTAAGGAAAAAGAAGAAGTAGAGGGGATATCAGTAGGTGCTATACTTTCTG
ACTATCAGCGTATTCGAGTGGAAAATGTGTGTAAAAGGCTTAATCTCCAGCCTTTAGCTTATCTTTGGCA
GAGAAACCAGGAAGATTTGCTCAGAGAGATGATATCATCTAACATTCAAGCAATGATCATCAAAGTAGCA
GCTTTGGGTTTAGATCCTGATAAGCATCTTGGGAAAACCCTGGATCAAATGGAGCCTTATCTCATAGAGC
TTTCTAAGAAGTATGGAGTACATGTTTGTGGAGAAGGTGGAGAGTATGAAACTTTCACTTTGGATTGCCC
TCTATTTAAGAAGAAAATAATTGTGGATTCATCAGAAGTAGTCATACATTCAGCTGATGCATTTGCACCT
GTGGCTTATCTACGCTTTTTAGAATTGCACTTGGAGGACAAGGTGTCCTCAGTGCCTGACAACTACAGAA
CATCTAATTATATATAATTTTTGAAAAGTGTTTTGGAACATTGTTCATTAAACCACCATTTCTATACA
AAAAAATTGCATAGTATTTCTCAGTTACTATGACTAGTTTATTTTTTCTCATGACTCTTATTTTTTA
GAGAAACATACTTTCACTAGAAGAGGTTAGTGGAACCATTTATTAATTGGGAAAATGTCGACGGCATGTT
CATTAATAGTGCCAACTTTCTTGGAATTCACTCTTTCTCTTTCGTTAACACATCTTCCCTATGACCTTTT
TTTTCTTTTATTTCATCTATAAACCCCATTTCTGTAGCATTTCTTTTTTATCACACTAGTTTCTTTTCC
TCCTTCTCTCTTTCTTGCTCCAATCCCTACCAATAATGTCATGATGCAGAGGCATTTGAAAATGAAGATG
AAAAGATGGTCACTTTATTTAGCCAGTCAAGCTTATTCTACTGGGTGTCGCCAAAGCGATTTATCATTTT
TATTTTAAATATATTCATGGTTGAAGTGTTTCAACGTTATTGGACAATTAGGAAGAATGTCCTTAACTCT
TACAAGTTATTTTATAACTGATTTTTAAAATGCTGTTTTTCAGTATTAACTATGTTGACCTTAGAAAACT
TTTACAAAAAATAGACTTTATGTTTTAGAACAGTTTTAGGTTCACAGCAAAAATGGAGCAGAAAATGCAG
AGATTTCCCATATACCCTCTACCTCCACACATTCACAGCCTCCCCTACCGTCAATGTCTTATAATAGAGT
GGTACATTTGTTACAACTGATGAACCTACATTGACACATTATTATCACCCAAAGTCCATAGTTTACGTGA
GGGTTCACTCTTGGTGTTGTACATAATATGGGTTTTGACAAATGTGTAATGACATTTGTCAACCGTTATA
GTATTATACAGAATAATTTCACTGCCTTAAAAAATCCTCTGTGTTTTACTTATTCATCCCTCCCTCTCCT
TTAACCCTTAGCAACTGATCTTTTCACTGTGTACATAGTTTTGCTTTTACCAGAATGTAATGTAGTTGAA
ATCATACAGTATATAGCTTTTCATGCAGTATATAGCTTTTCAGATTGGCTTCTTTCATGTATTAATATGC
ATTTAGGTTTCTCTGTATCTTGTCATGTATATGTAGCTCATTTTTTTTTTAGTGTAGAATAAAATTTTAT
TGTCTGGTTCTACCACAAAAAAAAAAAAAAAAAAAAAAAAAAAAAAAAAAAAAAAAAAAAAAAAAAAAAAA
AAAAAAAAAAAAAAAAAAAAAAAAAAAAAAAAAAAA
```

Figure 20 (Continued)

>gi|115527093|ref|NM_138288.3| Homo sapiens serine palmitoyltransferase, small
subunit A (SPTSSA), mRNA
GTGAGCGGGCGGCCGGCCGGACAGACTGACGTGTGAGCTGCATCGCGGGAGGCGCATGGCGGGGATGGCG
CTGGCGCGGGCCTGGAAGCAGATGTCCTGGTTCTACTACCAGTACCTGCTGGTCACGGCGCTCTACATGC
TGGAGCCCTGGGAGCGGACGGTGTTCAATTCCATGCTGGTTTCCATTGTGGGGATGGCACTATACACAGG
ATACGTCTTCATGCCCCAGCACATCATGGCGATATTGCACTACTTTGAAATCGTACAATGACCAAGATGC
GACCAGGATCAGAGGTTCCTTGGGGAAGACCCACCCTACGAAGTTGGAATGAGACCATCAGATGTGATAA
GAAACTCTTCTAGATGTCAACATAACCAACCTTATAAAGACTAAAATTCATGAGTAGAACAGGAAAATCA
TCCTGACTCATGTGTTGTGTTCTTTATTTTTAATTTTCAAAGAGGCTCTTGTATAGCAGTTTTTGTCTAT
TTTAACATTGTAGTCATTTGTACTTTGATATCAGTATTTTCTTAACCTTTGTGACTGTTTCAATATTACC
CCCGTGAAAGCTTTTCTTAATGTAACTTTGAGTACATTTTAATTGCCTTCTATTTTAAAACTCAAAATC
ATTAGTTGGGCTTTACTGTTCTTGCTATTGTATGGCATATACATCTGCCTGGATATATTTCTACTCTTGA
CCAAAGTTTTGTAAAGAACAATATAAGATTTCGGGTAGGGGTATGGGGAGGGAAGATATTTTATTGAGAA
CTACTTAACAAAAGATTTATCTGTAAGCTTGAACTCAGGAGTACAGTTTTAGCTATCTAGACTCTAACAG
CTTTTGCTTTAAAATTATTAAAGTGTTTCTTAATGAAAAAGAAAAGATCTTGCTAAAGTTAAAATAAGGA
ACATTTCACCTTTTAAATATTTAATTCTTATGTGGACTTATTTCCAGAAAACTTTGGTGATAATTCTTGA
GACAAAAGGTGGTTAAGTAGCATTATTATGTAATGCTTATATACCATAGAGTTTTTAATAGAAGAGAAAT
CCATTTCCTCCGAGGGTCACTATTAACAATGTACTTCCTTAAATTTAGTTTAATGATTGTAATGGGTGCT
GCATTTGCACATTGCATTAAGTTATGATGAGACGAATTGTTGTTAAAAATTATAGCAAAAAGAAATGTAA
ACTTGGTTAAAATCCTTTCACTCTTTGTATTGTTTTTTTTAAGGTTTTTATTCCTTAAATGTAAAATGAC
TACCTAATTTTTTGATGTAAATACATTAAATTCAAAGAGAAAAAAAATCAGCTGATGTAGCAGTATATCT
TTTCCTTGATGGTTAAATATTGATCTAGTATTTATATTGCTGAATTATTTTCTGTGGAGGACCAGATAAG
CAGTAAGTATGTCTTATCCTATATGTTTTGCAACATAAAAATATTGCTAATTGAAAAGAATTAGGCAATT
ATGTGTGTTGCTGGGTTGTTTTTTGTTTTTTTTTTTGAGACGGAGTCTTGCCCTGTCGCCCAGGATG
GAGTGCAACAGCATGATCTCGGTTCACTGCAACCTCCATCTCCTGGGATCAAGTGATTCTCCTGCCTCAG
CCTCCTGAATAGCTGGGATTACAGGCACCTGCCACCATGCCTGGCTAATTTTTTGTATCTGTAGTAGAGA
CGGGGTTTCACTGTGTTGGCCAGGATGGTCTCAAACTCCTGACCTCCTGATCCACCTGCCTCGGCCTCCC
AAAGTGCTGGGTTTACAGGCGTGAGCCACCGCGCCCGGCCAAAATTGAGGTATTTTTTGCCCTACGTTTT
AAGGACTAGACTTTTGAAGTATTTTATAGTCTAGAGGTCTCAAGTAATATATATGTGTTTAATATTTTTA
GAGCCAATTGATACCACAATTAGATAGGAGTAGTGAGAATAATATGGAATTACTTGGTTTGAAGTAGTTA
AAAATTGGATATGGTTATATCTGAGCTGTAGTCATATTATCTCAAGAAAATAATACGAGGATTTAACAT
AAGATTTGTTCTATTAATGCCCAAATTTGGCTTTCCTCTACTATCCCCCATAGAGAACCACTAACAAGTG
GATGTCTAATATTCCTCTGGTGAGTTGAAGGCAGGAGAAGTTGAGAATCATTAGTTTCAATGAGTATCCA
GGTGACCTATCCTGGCCCTCTACTCAGAAACCGGCAATTTGTCTTCACTCTGAGATTCATTAAATTGCTG
TTGTATAACTGATGGTTATTATGAACACTGACCTGTGAGACATATGGAAGATAAAGTTTGGTCTTACAGG
AAATCTTGAGGAGAGTCAAAAGAGAAATGGGAGATGTCTCTTGAGAGGTGATCAGAGAAGTTTATGCTCA
CTGTCTGATGCAAATGTCTGGTCTATTTGTTAGTAAATAACAGGGAAATCATTTTCACTTTTTGTTAAAA
ATAAGGTATTTACAAGCATACCTTGTAGTTATTGTGGGTTCAGTTTCAGACCACTGCAATAAAGTGAATA
TCTCAATAAAGTGAAAAA >gi|315360653|ref|NM_138395.3| Homo sapiens methionyl-tRNA synthetase 2,
mitochondrial (MARS2), nuclear gene encoding mitochondrial protein, mRNA

Figure 20 (Continued)

```
ATTGGCTTTCCGGCCGGAAGCTGCGGCGCGACCCGGCTGCGCATGCGCCTCTCACACGTGCTGTCAGAAC
GCCGCCTCCTCCGCTTGCGGCCGGTCTGCACCATGCTGCGAACGTCCGTCCTCCGCCTGCTAGGACGCAC
GGGGGCTAGTAGGCTGTCTCTCCTGGAGGACTTCGGCCCACGCTACTACAGTTCGGGCTCCCTCAGTGCC
GGCGATGATGCTTGTGATGTGCGCGCCTACTTCACTACACCCATTTTCTACGTGAACGCGGCGCCGCACA
TCGGGCACCTGTACTCGGCACTACTGGCGGACGCCCTATGCCGCCACCGTCGCCTCCGAGGTCCCAGCAC
GGCCGCCACGCGATTCTCCACTGGTACCGACGAGCACGGGCTGAAGATTCAGCAGGCAGCAGCTACCGCG
GGCCTGGCCCCGACCGAGCTGTGCGACCGAGTCTCTGAGCAGTTCCAGCAGCTTTTCCAGGAGGCCGGTA
TCTCCTGCACAGATTTCATCCGCACCACGGAGGCCCGGCACCGGGTGGCTGTGCAGCACTTCTGGGGGGT
GCTTAAGTCCCGCGGTCTGCTCTACAAGGGCGTCTATGAAGGTTGGTATTGCGCTTCCGACGAGTGCTTC
CTGCCTGAGGCCAAGGTCACCCAGCAGCCGGGCCCATCGGGGGATTCGTTTCCTGTATCTCTCGAGAGCG
GGCATCCAGTCTCCTGGACCAAGGAAGAAAACTACATTTTCAGGCTTTCCCAGTTCCGGAAGCCACTCCA
GCGGTGGCTGCGGGGCAACCCTCAGGCGATCACCCCCGAACCATTTCATCACGTAGTTCTTCAGTGGCTG
GACGAGGAGCTGCCCGACCTGTCCGTGTCTCGCAGAAGTAGCCACTTGCACTGGGCATTCCGGTGCCCG
GGGATGATTCGCAGACCATCTATGTATGGCTGGATGCCCTGGTCAACTACCTCACTGTAATTGGCTACCC
AAATGCTGAGTTCAAATCTTGGTGGCCGGCCACCTCTCATATCATAGGTAAGGACATTCTCAAATTCCAT
GCCATCTATTGGCCTGCCTTCCTGTTAGGGGCCGGCATGAGCCCGCCACAGCGCATCTGTGTCCATTCCC
ACTGGACAGTCTGTGGCCAAAAGATGTCCAAGAGCTTGGGCAACGTGGTGGATCCTAGGACTTGCCTTAA
CCGCTATACCGTGGATGGCTTCCGCTACTTTCTCCTTCGGCAGGGCGTCCCCAACTGGGACTGTGACTAC
TATGATGAAAAGGTGGTTAAGTTGCTGAACTCCGAGCTGGCAGATGCCTTGGGAGGTCTCTTGAACCGAT
GCACTGCCAAAAGAATAAATCCTTCTGAGACCTACCCAGCCTTCTGCACTACCTGCTTCCCTAGTGAGCC
AGGGTTGGTGGGGCCGTCAGTTCGTGCTCAGGCAGAGGATTATGCTCTGGTGAGCGCAGTGGCCACTTTG
CCAAAGCAGGTAGCAGACCACTATGATAACTTTCGGATATATAAGGCTCTGGAGGCCGTGTCCAGCTGTG
TCCGGCAAACTAATGGTTTTGTCCAAAGGCATGCACCATGGAAGCTGAACTGGGAGAGCCCAGTGGATGC
TCCCTGGCTGGGTACTGTGCTTCATGTGGCCTTGGAATGTTTGCGAGTCTTTGGGACTTTGCTGCAGCCT
GTCACCCCAAGCCTAGCTGACAAGCTGCTGTCTAGGCTGGGGGTCTCTGCCTCAGAGAGGAGTCTTGGAG
AGCTCTATTTCTTGCCTCGATTCTATGGACATCCATGCCCTTTTGAAGGGAGGAGGCTGGGACCTGAAAC
TGGGCTTTTGTTTCCAAGACTAGACCAGTCCAGGACTTGGCTGGTGAAAGCCCACCGGACCTAGAAACTC
AGTTCTTACCGGCTTGTGGTAAAAAAGCAAATGTGTTATCTTTTTATTTTTATTTTCAGGAAAGTTATA
CTAGTATTTTCTTAAGTGTGGAATCAAATGAGCACATAAGCTGTGTCCCTGTGAAAAGAGGTTTGTAGCC
TTTCAGGTGCCTGCTCCTATTCATTTCTCTGTGACCATTGATCACTGTCCTTTGTGCATTGTGTGTCTAA
GATGTCTTCAGGGGAAAGATGGGTAAGAGACAGTGTTGCTAATGCTGTTCCTTCTTTGTGCCTCCTTCCA
AACCACAGTTATTTGCCCAAACTACCTCTCGTGGCTGGTTTTTCATTGGCCTGGCCTCTGCTTCTCAGGC
TAATTAGTGACTCCTTTCTTTGAGGGTCAGGGTTGGAGGCCCCTTACTGGTGGTTTTACAGGGGATCCT
ACTTTGTTACACATGTTGGGTTTCCTGATAAAAAGAGAGTATTTTATTAAACCCTTGAACCAGTGTCCTA
GACCAGATGATTTTTGCCCATGTGTATCCCCATTTAAATTCCTACAACTAAGTCTCCCTGCTTTGTTAAT
AGTCCAACAGTTGGGTTGTGTAACATCACACTTCAACCGGTAGATGGCTCTAATCTCACACATTTACTTA
CTAAAGATTGAGGATTCGGAATATTTAGAATAAATTAGTTTTCTGCTTTCTAATTTTGCAGATCTTTACA
TTTTTATTGCTTTTCTTAAAATAAGGGATAGCTTTGCAACCACTATTGTTTTAATGGAAAGCAAAAAACC
CCCCCAAACTTATCAGAATCCTCGTTCTTTTTCAGACTACTGAAAAATGACATTTACTCTGTTAAATGTT
TAATAAGTGAATAAGTAAATGTATCAAGTTGTTTATATAATAAATTATAAAACTCTTGAGGCACTTGGTA
TGTTAAAAATTTTAAACTTTAGTAACATTAGGTTACAGGTATGATTTAAAAATTTGTAAATAGTTCAAAA
GGGCAATGTTTTCTTTATATTTCTTATAGTCTTAATTTTGTTATCCATGTGCATAATTTACCTCATGATT
```

Figure 20 (Continued)

TCTTTTGGTCAATCAGGATCTTTAATACAATATAGAAATTGTGTAATAGTTATTATAAATGTTAATACAC
AACTTTCAGGTAATTTTAACTGATTATTTCTTTTGCTCTTTTAACTTAAGTTATTAAAGTTTAAAAGTTC
GTAAGTAAAAAAAAAAAAAAAA

>gi|40316948|ref|NM_138430.3| Homo sapiens ADP-ribosylhydrolase like 1 (ADPRHL1),
transcript variant 1, mRNA
TGACCACTATAAAAGTCAGGCGGGCTGAGGAGGAGACAAAGGCCAGGACGCTCCGCAGCTGTTGGGGAAG
AGGAGCTGCCTCCTGGGATGGAGAAATTTAAGGCTGCGATGTTGCTGGGGAGCGTCGGCGATGCTCTTGG
CTACAGAAATGTCTGCAAGGAGAACAGCACTGTAGGCATGAAGATCCAGGAGGAGCTGCAACGTTCCGGG
GGCCTGGACCACCTCGTACTCTCGCCAGGAGAATGGCCCGTGAGTGACAACACCATCATGCACATCGCAA
CCGCCGAGGCCCTCACCACAGACTACTGGTGCCTGGATGATCTGTACCGGGAGATGGTGAGATGCTATGT
GGAAATCGTTGAGAAGCTTCCAGAACGCCGGCCAGACCCAGCTACCATTGAAGGCTGTGCTCAGCTAAAG
CCCAATAACTACCTTCTCGCCTGGCACACACCGTTCAATGAAAAAGGCTCAGGGTTTGGAGCGGCCACCA
AGGCCATGTGCATCGGCCTGCGGTACTGGAAGCCTGAGCGGCTGGAGACCCTCATCGAGGTCAGCGTGGA
GTGCGGCCGGATGACCCACAACCATCCCACAGGCTTCCTGGGCTCCCTGTGCACGGCCCTGTTTGTGTCG
TTCGCCGCACAAGGAAAGCCCCTGGTCCAGTGGGGAGAGACATGCTGCGGGCGGTGCCTCTGGCAGAAG
AGTACTGCAGGAAGACCATCCGGCACACGGCAGAATACCAGGAGCACTGGTTTTACTTTGAAGCTAAATG
GCAATTTTATTTGGAGGAGAGGAAAATCAGTAAAGACTCAGAAAATAAAGCCATCTTCCCCGACAATTAT
GATGCAGAAGAGAGGGAAAAGACCTACAGGAAGTGGAGCTCGGAAGGTCGAGGGGGAAGACGAGGCCACG
ATGCCCCCATGATAGCCTATGACGCCCTCCTTGCAGCAGGAAACAGCTGGACTGAGCTGTGTCACCGGGC
CATGTTTCATGGAGGGGAGAGCGCGGCCACGGGCACCATTGCAGGCTGCCTGTTCGGGTTGCTGTACGGC
CTGGACCTCGTTCCCAAAGGCTTGTACCAGGACCTGGAGGACAAGGAGAAGCTGGAGGACCTGGGCGCGG
CTCTCTACCGCCTGTCCACAGAGGAGAAGTAAAGCCATTTCTGCCACTTTCCCCCTAGAGAGCCGATTCC
ACCCCGGGGCCCGTAGGGCCCTCTCGCAGCCCTGGGTGAGGGTGTCTCTGTGAGGCTCCACTGCGGTCT
GTGCCTGACTGGCCACATCTAACTCTCTGTTTCCAATTTCAGAATCCTAACTGTTGCATAAAATACATTG
TTTGTCCTGCGAGAATATTTTCCGTCCTCCACCATCAACATTGACACTGCGTAGATTTGCCGCACTTGGA
CCTCCATGCGTGGCACTCACCCGCAGTCTCCTGGACAGGCGCTGTATTTTATTCTGTCGCAGAGCTAATG
CTGTTTACTCACTCACTTCAACAACACTAACTGCGGTGGTGGCCTCCAGCAGGCCCCCCCGCTGCAGACC
CTCTGTCCTGCCTCTGCCTCCAGGCATGCGTTTCCCCGTGAGGGCCAATGCACCTCCCCCCACCCCCCAC
CCTCCCATGTCCACAGTGGGTCGTGTGTTCCTGGACAGAGAAACAGTCCACACTGGGGCCTGCGGGACAC
ATATAGCAGCATATTTTGCTCTTAA >gi|45505153|ref|NM_138492.4| Homo sapiens PRELI domain containing 2 (PRELID2),
transcript variant 3, mRNA
GGGCGCCTCCGGGCCTCTGCGGAGCCCTGGGCAGCTCTGAGCTCGCGGAGGCGTGGCCGGTGCGCGGGGC
CCGCGGCGCGCGGGGATGGGGGTCTCGGTGGATGTGCACCAGGTGTACAAGTACCCCTTCGAGCAGGTGG
TCGCCAGCTTTCTCCGAAAGGTTTCCACGCTTTGAGAAGGACTGAATGAGATCATGCGCATGGCAGCTTC
TCTAGGATAGCACCCTGCGTGAACACAGTAGCTGCTCAGTTAAGTCTTTGATGGGTGTGATCCTGATTCA
GCTTGATCAATTCTGCAGTCATACTGGATTGTGTTTGAAAAGGTGTCCAGAAAAACCTGGCCATCTGCCT
CCTGTCTTCCCAGTACCCCAACCCCATGGATAAAAATGTCATCTCAGTAAAAATCATGGAGGAAAAAGA
GATGAATCAACAGGGGTCATCTACAGAAAGAGGATTGCAATCTGTCAGAACGTGGTTCCAGAAATTTTAA
GGAAGGTGAGCATTTTGAAAGTACCTAATATCCAATTAGAAGAGGAGTCATGGCTCAATCCTCGGGAAAG

Figure 20 (Continued)

```
AAACATGGCCATACGGAGTCACTGCCTTACGTGGACACAGTATGCATCCATGAAGGAAGAGTCTGTCTTC
CGGGAAAGTATGGAAAACCCAAATTGGACAGAGTTCATTCAAAGAGGCAGGATTTCAATCACAGGGGTTG
GATTTCTCAACTGTGTTTTAGAAACTTTTGCCAGCACATTCTTACGACAGGGAGCCCAGAAGGGAATTAG
AATCATGGAGATGCTGCTAAAGGAACAGTGTGGTGCCCCCTTAGCTGAATAAAGAATCATCAGAGAGCTG
TATCCATGTCTACTTTTTTATTTATTTATTTTTTTTTGAGAATCACTTCTTGGCCACAGCACATCACAG
ACACAGTTTCTGGAATACAGGTTTGAGGATACAGTGTTGGCAGCTTCAAGAAGAGAAGACCTTCTTGCCA
GGACATAAAATGATACCCTCCTCTGGGAGCCTGCTTCGAATAGTGGGACTCAGGGAGATAAGACCTTCTT
GCTGGATTTTTATGACACAATCTCTTTATAATTTTACAAATAAAGGAAAAAAGACCCATGTAAGATATGT
GTGCCCTTCCTCAGGGTGTTCTGCTGGTTGTCTGATGATGGTGTCAGGGCAGCTAAGGACAGGATAAAGG
CCTGGAGAGGGTGCTTGTGCCCTTATGTTATCAGCACCGTTGTTCCTAGGATTCGTGAGGGATTCTGGA
ACCAATAAGGGAGTTGAACTGGTACCTGATTCACGGGTGGACTGGAACAAACAGGAATGTACCAGACCTA
TGTTGAAGCTAAGCCGTATTTATAACAATGTTTAAGATTCTCAGAAATCAGGAGATTTTTATCCTATCCA
TAAGTAATATGTAACTGCCATAAGTATAGCTTTTAGAATGTAATATGTAAACTGCGATTTGGTCCTCTGG
AAAAAAAAAATGAAATGAAGAGTGGGAAGGCAGTTTCTTTTCTGCTAATTCGTTCTGTGATGGTGAGCA
AGCAAATCATTAACCTCTCTGTTTTTTATTGGGCAAATGGGGATAATCAGGCACAGGTCTTTCCGCCAAT
GCGTTATGATGATTAAAGAAGGTAATTTTGTGCAGGGTTTTAAGTCAACAGACAGACCTGGGTTTGAATC
CAAGTGCTGGCACCTACTTGCTCAGTGATCATGAACACAATTTTAAATCTTTCTGAATCTCATTTAAAAA
AATTTGTGAAACAAGATGATAGAATTAATTTTGTGAGATTGTTGGACTGATTTGAGATCATGCCTATGAA
GTACCTAGCACACTGCCTAGTACATAGTAGAAGTCCAGGAAATGGAAGCCATTATTATGTAAAACGTTTT
GCAAAGGTACTTTTTAACTGTAACGTAAAGTGGTACTACTGTTTGAAACTTAGATGGCAGTAGTTTGCAT
TTCTCGTGATCAGAAGCCAAAATATAAATACATACTACCTAAAAAATCTTGAAGAGAGGTAATAATTTGA
AATTCATCTTCTTAAGATAAAAATCAGGGCAGGGTGTGGTGGCTTATGCCTGTAATCCCAGTACTTTGGG
AGGCCGAGGCGGGTGGATCACAAGGTCAGGAGTTCGAGACCAGCCTGGCCAATATGGTGAAACCCCGTCT
CTACTAAAAATACAAAAAAATTAGCTGGGCGTGGTGGCGCATGCCTGTAATCCTAGCTACTTGGGAGTCT
GAGGCAGGAGAATTGCTTGAACTCAGGAGGTGAAGGTTGCAGTAAGCTGAGATTGTGCCACTGCACCCCA
GCCTGGGTGACAGAGCAAGACTCCATCAC

>gi|346716180|ref|NM_139348.2| Homo sapiens bridging integrator 1 (BIN1),
transcript variant 6, mRNA
CGTCAGGGGAGTCCCGCTCGCCGCAGCCCCAGCGCCGCGCGCGCCCCTCCCTCCTCGCGGACCTGGCGGT
GCCGGCGCCCGGAGTGGCCCTTTAAAAGGCAGCTTATTGTCCGGAGGGGGCGGGCGGGGGGCGCCGACCG
CGGCCTGAGGCCCGGCCCCTCCCCTCTCCCTCCCTCTGTCCCCGCGTCGCTCGCTGGCTAGCTCGCTGGC
TCGCTCGCCCGTCCGGCGCACGCTCCGCCTCCGTCAGTTGGCTCCGCTGTCGGGTGCGCGGCGTGGAGCG
GCAGCCGGTCTGGACGCGCGGCCGGGCTGGGGGCTGGGAGCGCGGCGCGCAAGATCTCCCCGCGCGAGA
GCGGCCCCTGCCACCGGGCGAGGCCTGCGCCGCGATGGCAGAGATGGGCAGTAAAGGGGTGACGGCGGA
AAGATCGCCAGCAACGTGCAGAAGAAGCTCACCCGCGCGCAGGAGAAGGTTCTCCAGAAGCTGGGGAAGG
CAGATGAGACCAAGGATGAGCAGTTTGAGCAGTGCGTCCAGAATTTCAACAAGCAGCTGACGGAGGGCAC
CCGGCTGCAGAAGGATCTCCGGACCTACCTGGCCTCCGTCAAAGCCATGCACGAGGCTTCCAAGAAGCTG
AATGAGTGTCTGCAGGAGGTGTATGAGCCCGATTGGCCCGGCAGGGATGAGGCAAACAAGATCGCAGAGA
ACAACGACCTGCTGTGGATGGATTACCACCAGAAGCTGGTGGACCAGGCGCTGCTGACCATGGACACGTA
CCTGGGCCAGTTCCCCGACATCAAGTCACGCATTGCCAAGCGGGGGCGCAAGCTGGTGGACTACGACAGT
GCCCGGCACCACTACGAGTCCCTTCAAACTGCCAAAAAGAAGGATGAAGCCAAAATTGCCAAGGCCGAGG
```

Figure 20 (Continued)

```
AGGAGCTCATCAAAGCCCAGAAGGTGTTTGAGGAGATGAATGTGGATCTGCAGGAGGAGCTGCCGTCCCT
GTGGAACAGCCGCGTAGGTTTCTACGTCAACACGTTCCAGAGCATCGCGGGCCTGGAGGAAAACTTCCAC
AAGGAGATGAGCAAGCTCAACCAGAACCTCAATGATGTGCTGGTCGGCCTGGAGAAGCAACACGGGAGCA
ACACCTTCACGGTCAAGGCCCAGCCCAGTGACAACGCGCCTGCAAAAGGGAACAAGAGCCCTTCGCCTCC
AGATGGCTCCCCTGCCGCCACCCCCGAGATCAGAGTCAACCACGAGCCAGAGCCGGCCGGCGGGGCCACG
CCCGGGGCCACCCTCCCCAAGTCCCCATCTCAGCTCCGGAAAGGCCCACCAGTCCCTCCGCCTCCCAAAC
ACACCCCGTCCAAGGAAGTCAAGCAGGAGCAGATCCTCAGCCTGTTTGAGGACACGTTTGTCCCTGAGAT
CAGCGTGACCACCCCCTCCCAGCCAGCAGAGGCCTCGGAGGTGGCGGGTGGGACCCAACCTGCGGCTGGA
GCCCAGGAGCCAGGGGAGACGGCGGCAAGTGAAGCAGCCTCCAGCTCTCTTCCTGCTGTCGTGGTGGAGA
CCTTCCCAGCAACTGTGAATGGCACCGTGGAGGGCGGCAGTGGGGCCGGGCGCTTGGACCTGCCCCCAGG
TTTCATGTTCAAGGTACAGGCCCAGCACGACTACACGGCCACTGACACAGACGAGCTGCAGCTCAAGGCT
GGTGATGTGGTGCTGGTGATCCCCTTCCAGAACCCTGAAGAGCAGGATGAAGGCTGGCTCATGGGCGTGA
AGGAGAGCGACTGGAACCAGCACAAGGAGCTGGAGAAGTGCCGTGGCGTCTTCCCCGAGAACTTCACTGA
GAGGGTCCCATGACGGCGGGGCCCAGGCAGCCTCCGGGCGTGTGAAGAACACCTCCTCCCGAAAAATGTG
TGGTTCTTTTTTTTGTTTTGTTTTCGTTTTTCATCTTTTGAAGAGCAAAGGGAAATCAAGAGGAGACCCC
CAGGCAGAGGGGCGTTCTCCCAAAGATTAGGTCGTTTTCCAAAGAGCCGCGTCCCGGCAAGTCCGGCGGA
ATTCACCAGTGTTCCTGAAGCTGCTGTGTCCTCTAGTTGAGTTTCTGGCGCCCTGCCTGTGCCCGCATG
TGTGCCTGGCCGCAGGGCGGGGCTGGGGGCTGCCGAGCCACCATGCTTGCCTGAAGCTTCGGCCGCGCCA
CCCGGGCAAGGGTCCTCTTTTCCTGGCAGCTGCTGTGGGTGGGGCCCAGACACCAGCCTAGCCTGGCTCT
GCCCCGCAGACGGTCTGTGTGCTGTTTGAAAATAAATCTTAGTGTTCAAAACAAAATGAAACAAAAAAAA
AATGATAAAAACTCTCAGAAAACGTGAAAAAAAAAAAAAAAA

>gi|225703134|ref|NM_144492.2| Homo sapiens claudin 14 (CLDN14), transcript
variant 1, mRNA
CGCCAGGTGGTGGCTCAGAGGAGGACACAGTCGCTGTGGGCAGGTGGTCAGGGCGCAGGAGGGAATGAGC
TGTGGATTTTTAGTAATCTACAACAATCAGGCAGTTCCAGGACACAGGGAAGTGAGTGTGAACAGCCAAT
GGACCCGGAGCCGAGAGCCTGGGCAGGCGTAGGCTGGACTATGGACGCCCTGCAACCCTGCCAGGCTGGG
AAGGGGAGGCTTGATCCTGAGCGCGTGTTAGGAAGGAGATGCCCAGGTTCAGGTGTATCGTGCATTTTTT
TTCCACAGTGCAGAAATGACATTTCTGGTTGGTCTTGAATGTCTGCTCTGGCCAAGCCACCTCCTCTCAT
GCTAGCTAACCAAGTGGCACGTGTGCCCACGCAGGCCATTCTAAGGAACACTGTAATTGTCTAGACAATT
TTCTCTCAAATACTCCGTCCTGGAAGCGTCTGGTTGGCAGAAGAGGGAAGGCAGGAGGGTGGCAGCGTCC
CGGCTGAGTCCTCTTGCACATGGGAGCTGGAGTCCAGCCAGGCTCCAGAGCGGCTCCGGCTGGCAAGGGA
CCTGAACAGGAAGATGAGACTCGAGGTTTTCTGCATGCCTGGAAGTGCACATGCTCATCTACAGCTTTCT
TGGAAGAAGAAAGAAACAAAAACTGAGATTTAGAACACCAGGTCTGTTTCCACTGGCGGCCACTCTTGGG
CACTGGAGACCAGCAAGAGCTTTGTTTTTAAAAGGCTCTTCCATGGCAGATATTCGCAGAGGCATCAGGG
CTACACTTAAATGAAGGGCTCCGGCTGGCACCTGAGGAGCGGCGTGACCCCGAGGGCCCAGGGAGCTGCC
CGGCTGGCCTAGGCAGGCAGCCGCACCATGGCCAGCACGGCCGTGCAGCTTCTGGGCTTCCTGCTCAGCT
TCCTGGGCATGGTGGGCACGTTGATCACCACCATCCTGCCGCACTGGCGGAGGACAGCGCACGTGGGCAC
CAACATCCTCACGGCCGTGTCCTACCTGAAAGGGCTCTGGATGGAGTGTGTGTGGCACAGCACAGGCATC
TACCAGTGCCAGATCTACCGATCCCTGCTGGCGCTGCCCCAAGACCTCCAGGCTGCCCGCGCCCTCATGG
TCATCTCCTGCCTGCTCTCGGGCATAGCCTGCGCCTGCGCCGTCATCGGGATGAAGTGCACGCGCTGCGC
CAAGGGCACACCCGCCAAGACCACCTTTGCCATCCTCGGCGGCACCCTCTTCATCCTGGCCGGCCTCCTG
```

Figure 20 (Continued)

```
TGCATGGTGGCCGTCTCCTGGACCACCAACGACGTGGTGCAGAACTTCTACAACCCGCTGCTGCCCAGCG
GCATGAAGTTTGAGATTGGCCAGGCCCTGTACCTGGGCTTCATCTCCTCGTCCCTCTCGCTCATTGGTGG
CACCCTGCTTTGCCTGTCCTGCCAGGACGAGGCACCCTACAGGCCCTACCAGGCCCCGCCCAGGGCCACC
ACGACCACTGCAAACACCGCACCTGCCTACCAGCCACCAGCTGCCTACAAAGACAATCGGGCCCCCTCAG
TGACCTCGGCCACGCACAGCGGGTACAGGCTGAACGACTACGTGTGAGTCCCCACAGCCTGCTTCTCCCC
TGGGCTGCTGTGGGCTGGGTCCCCGGCGGGACTGTCAATGGAGGCAGGGGTTCCAGCACAAAGTTTACTT
CTGGGCAATTTTTGTATCCAAGGAAATAATGTGAATGCGAGGAAATGTCTTTAGAGCACAGGGACAGAGG
GGGAAATAAGAGGAGGAGAAAGCTCTCTATACCAAAGACTGAAAAAAAAAATCCTGTCTGTTTTTGTATT
TATTATATATATTTATGTGGGTGATTTGATAACAAGTTTAATATAAAGTGACTTGGGAGTTTGGTCAGTG
GGGTTGGTTTGTGATCCAGGAATAAACCTTGCGGATGTGGCTGTTTATGAAAAAAAAAAAAAAAAAAA

>gi|193804849|ref|NM_145177.2| Homo sapiens dehydrogenase/reductase (SDR family)
X-linked (DHRSX), mRNA
AGAGTCCCGCGGCGGCGCGGAAGCGGCGGCGGCGCGGCCGGGGCAGCCATGTCGCCATTGTCTGCGGCG
CGGGCGGCCCTGCGGGTCTACGCGGTAGGCGCCGCGGTGATCCTGGCGCAGCTGCTGCGGCGCTGCCGCG
GGGGCTTCCTGGAGCCAGTTTTCCCCCACGACCTGACCGTGTCGCTATAGTGACGGGAGGGACAGATGG
CATTGGCTATTCTACAGCGAAGCATCTGGCGAGACTTGGCATGCATGTTATCATAGCTGGAAATAATGAC
AGCAAAGCCAAACAAGTTGTAAGCAAAATAAAAGAAGAAACCTTGAACGACAAAGTGGAATTTTTATACT
GTGACTTGGCTTCCATGACTTCCATCCGGCAGTTTGTGCAGAAGTTCAAGATGAAGAAGATTCCTCTCCA
TGTCCTGATCAACAATGCTGGGGTGATGATGGTCCCTCAGAGGAAAACCAGAGATGGATTCGAAGAACAT
TTCGGCCTGAACTACCTAGGGCACTTCCTGCTGACCAACCTTCTCTTGGATACGCTGAAAGAGTCTGGGT
CCCCTGGCCACAGTGCGAGGGTGGTCACCGTCTCCTCTGCCACCCATTACGTCGCTGAGCTGAACATGGA
TGACCTTCAGAGCAGTGCCTGCTACTCACCCCACGCAGCCTACGCCCAGAGCAAGCTGGCCCTTGTCCTG
TTCACCTACCACCTCCAGCGGCTGCTGGCGGCTGAGGGAAGCCACGTGACCGCCAACGTGGTGGACCCCG
GGGTGGTCAACACGGACGTCTACAAGCACGTGTTCTGGGCCACCCGTCTGGCGAAGAAGCTTCTCGGCTG
GTTGCTTTTCAAGACCCCCGATGAAGGAGCGTGGACTTCCATCTACGCAGCAGTCACCCCAGAGCTGGAA
GGAGTTGGTGGCCATTACCTATACAACGAGAAAGAGACCAAGTCCCTCCACGTCACCTACAACCAGAAAC
TGCAGCAGCAGCTGTGGTCTAAGAGTTGTGAGATGACTGGGGTCCTTGATGTGACCCTGTGATATCCTGT
CTCAGGATAGCTGCTGCCCCAAGAAACACATTGCACCTGCCAATAGCTTGTGGGTCTGTGAAGACTGCGG
TGTTTGAGTTTCTCACACCCACCTGCCCACAGGGCTCTGTCCTCTAGTTTTGAGACAGCTGCCTCAACCT
CTGCAGAACTTCAAGAAGCCAAATAAACATTTTGGAGGATAATCACCCCAAGTGGTCTTCAACCATAAAC
TTTGTGATTCCAAAGTGCCCAGTTGTCACAGGTGCCATAAATAATTACATTTTCCAACATAAATGTGCCA
TTTTCCTTGCCGCGTTAATACAACTGAGTACAAAAGTTCCAAGAGAGATGCTCTCTTTTCAGGGGCTGCA
ATGTCCTCTCTGAGACCTAGTGGTGGATGAGGTCTCCTGTTTGATTTTGTTCCTGCACTCACTCATTTTT
CCAGAGACCCAGCTGTGATTCACAGGTGTCAGACATGGGGAGGTGTGAGCCTTGCTTGCTACAGCCTGTA
GGATGAGTTTGACGTGGCCAGCAGCACCATCTGGTCAACCTCATTCCAGAATGGCACAGTCACAAGTGAA
GCATGCCACTGTCAAATCCGAGAATGTAAACCGCTGAACAGCTATGGATCAAATGGTAGCCCTCAAAAGA
TATGTTCATGCCCTAACCCTCAGAACCTATAAATATTACTTTATTTGGAAAAGAATCTTTGCAGATAGAA
TTAAGAATTTTGAGATGGGTCATTATGGATCATCCCAGTGAACCTAATGCCATCACGAGGGTTCTTATCA
GAGACAGGTAGAGGGAGATTTGAGTACAGAAGACAAGATATTCGTGTGATGATGCAGACAGAGACTGGAG
TGATGCCACCACAAGCCAAGCAATGCCTGGAGCCACCAGGAGCTGGGACAGGCAGGAAGGATTCTCCCTT
ATACCCCTCAGAGCAATCTTGGCCCCTCTGACGTCTTGACTTTAGACTTCTGGTCCCCAGAACGGAGAGA
```

Figure 20 (Continued)

```
GAATAAATCTTTCTTGTTTTAAGGCTCCAACAAATTGGTAGTCACTTGTTACAGCAACCACAGGAAATGT
ATACAGCTTCTGATACTTCTGAAAACCTCACACAGCCAAAGGGTACATCCTTGGTATAGAGGCTCACTCT
TACTCACCAGCCAGGCAAGGAAGGCTCAATCCTTTGGTGTTAGAGAGATAGATGTTGGGTTTTCAAATTT
CAACATAGAGAAATCAGTCATTTGCAATGCTTTTGAGAAAGTACTGTGTATACCCTACGAGCCTGCACTC
CTTATGTGTGAGACTGATGACCATTGGTTGGCTTATTATCCATTCCACTAAGTGACAAAATCCCACTGAC
TATTCAAATCCAGGCTCCTGGCATGCCTGTACCTTAGAATCACAACCAGCTGCAATTCCAGGATGGAGTT
CAAACTAATTGTGGGGGCATGTGCTTCTTACATGACTGCTAGATTGTTCCCAGATGGGGAAGGTTGCCCT
GATAAGCAACTTAAATGAAAATAATAAATGTATTGTTTGGCCTCTTTAAAAAAAAAAAAAAAAAAAAAAA
AAAAAA

>gi|197304739|ref|NM_145268.3| Homo sapiens chromosome 7 open reading frame 45
(C7orf45), mRNA
ATCTTTATCCCTTTAAGCATGGTTTATTTTCTGAGCAAGGAGTCATCATGGGAGACCTTTTTTCCTTATT
TTGGGAGGTAGATCCTCCCCCAATACCTGTAAATTGTGCCATTCCAAATCAGGATTATGAATGCTGGAAG
GATGACTCTTGTGGAACCATAGGGAGCTTCCTGCTTTGGTATTTTGTTATCGTATTTGTCCTGATGTTCT
TCTCTAGGGCTTCTGTCTGGATGTCTGAGGATAAAAAGGATGAAGGCAGTGGGACAAGTACTTCAGTAAG
GAAAGCAAGCAAAGAGACTTCCTGTAAGCGGCAAAGCAAAGACAGTGCCTGGGATCCCTCACAAACAATG
AAGAAACCAAAGCAGAACCAACTTACCCCTGTAACCAACTCAGAAGTGGCTTTGGTCAATGCCTATCCTG
AACAAAGACGAGCCAGGCGCCAGTCTCAGTTCAATGAGGTGAACCAGAACCAACATGACAGTGATACTAC
GGAGTATGGCAGTGAAGAGTCTAACTCAGAAGCCTCCTCGTGGAAGGAGAGTGAAAGTGAACACCACCCA
TCACCAGACAGTATTAAGAGGAGAAAAATGGCTCAGAGGCAAAGGAATCTGGGAAGTTACCAAATGAGCG
AAAGGCACTGCCTCCACTGCAAAGCCTTGAGAACCAACGAATGGTTGGCGCACCATTCCCGACAGAAGCC
TTCAGTAACACCGCCAATGAAAAGAGACAGTCAAGAGGAAAGTTCCATATCTGACATTAACAAGAAATTT
AGTAAATTTTGAATTTTATCACGTTCTTCCTTCACTTGAAGCCAAATGAAAGAGATGAATAAAACATGAA
AAATCACCAGAGCTATAGGTGAGGAGACTTTTACAACAAAGTCTCTCTACCAACAAACAAAAACATACTT
GGAACCCAAGAGGTAAAATCTCACACAATTCTTCGTTCAAAAAAAAAAAGGCCATCACGTGTTTATGGCA
CCATTGGAACACCAAAGATCTATATCTGCTATGATTTTTTTATTTGAAATAGCACAAGACAGATATTTTG
TGCCTTGAGTGTATATATTTTGTGCCTTGAGTGTATGTATTTTGTTTATGTCTGTAATATGAATAAGAAA
GCTCTTTGAAAATGTATTATTTATGTTGAGAAACCAAAAAAAAAAAAAAAA >gi|149588739|ref|NM_145306.2| Homo sapiens chromosome 10 open reading frame 35
(C10orf35), mRNA
AGGTGGGAGGAAACCGCCTGGAGCCGCCGGGAGTGGACGCCGCCGAGGCCCGGAGTCGCGCCTGCAGACA
CAGCATCTACTCAGCGTGGGTCACCTCTGTGAACATCACTGACTGCAAGCCTCCCTCAATTTCTGGTGCA
GCCCATCAGGGACCCACAGCGCCTGGGAGGATGGTGCGGATCTTGGCCAATGGGGAAATCGTGCAGGATG
ACGACCCCCGAGTGAGGACCACTACCCAGCCACCAAGAGGTAGCATTCCTCGACAGAGCTTCTTCAACAG
GGGCCATGGTGCTCCCCCAGGGGGTCCTGGCCCCGCCAGCAGCAGGCAGGTGCCAGGCTGGGTGCTGCT
CAGTCCCCCTTCAATGACCTCAACCGGCAGCTGGTGAACATGGGCTTTCCGCAGTGGCATCTTGGCAACC
ATGCTGTGGAGCCGGTGACCTCCATCCTGCTCCTCTTCCTGCTCATGATGCTTGGTGTTCGTGGCCTCCT
CCTGGTTGGCCTTGTCTACCTGGTGTCCCACCTGAGTCAGCGGTGACCTCTGAGGGCTGATAGGGGTGGG
TTTGTTGAGAGGGACTTGCTGGGCCTTGGTGTGAGAGCAGGCATATTTGGAGGGGATCTGGTGGTGCCTT
GAAGGTATGATCAGAGAGGGGACCACAGGTGTGTGTTTCCCCTTTGTGTTAAGCGTGAGGCAGAGGGAGA
```

Figure 20 (Continued)

```
CGTTAGTCCAGCATTTCCAAAGTGTGGGTGGGTCCGTTGGTTCCCAAGATACTTTTAGGTGGTATGGGGC
CTGCATTAAGTGGCACAAAATCAGAGCAAGAAAGCGATGCCCTTCCCAATTCTCTCAATCCTTTTATGCC
GAGAAGATCTCAGCTGGATGCCAACATGTTCCGATGCCTGTGGAAGACATGCCGACGTCTCCTCTGCCTA
GGGAGCAGGACTTGGGCTTAGGGCAGGTGGAAAAAATTCCAGACTTTTTTAGCACTGTTTTTGTTTTAAT
GGTATATTTTTATTGGCTACTTTATTGTTTAGGACAAGTGGTAGTGGCATTCTATTTATTGTGACCTTTT
CAATAAATAGATTTAAGTAAAAATGAAAAAAAAAAAAAAAAA

>gi|118421084|ref|NM_152259.3| Homo sapiens chromosome 15 open reading frame 42
(C15orf42), mRNA
ATGGCATGCTGTCACAAAGTAATGCTGCTGCTGGACACCGCGGGCGGCGCCGCCCGCCACAGCCGGGTCC
GGCGGGCCGCCCTGCGCCTCCTCACCTATCTGAGTTGCCGATTCGGCCTGGCCAGGGTCCACTGGGCCTT
CAAGTTCTTTGACTCGCAGGGGGCGCGGAGCCGGCCGTCCCGCGTGTCTGACTTCCGCGAGCTGGGGTCC
CGCTCGTGGGAGGACTTTGAGGAGGAGCTGGAGGCCAGGCTCGAGGATCGCGCCCACCTGCCCGGCCCGG
CGCCCAGGGCCACCCACACGCACGGCGCCCTGATGGAGACGCTGCTAGACTACCAGTGGGACCGGCCCGA
GATCACGTCGCCCACGAAGCCGATCCTGCGGAGCAGCGGGAGGAGACTGCTGGACGTGGAGAGCGAGGCC
AAGGAGGCCGAGGCCGCGCTCGGGGGCTTGGTGAACGCCGTCTTCCTCCTGGCCCCCTGTCCGCACTCGC
AGAGGGAGCTGCTGCAGTTCGTGTCTGGGTGCGAGGCCCAGGCCCAGCGCCTGCCGCCCACCCCTAAGCA
GGTGATGGAGAAGTTGTTGCCCAAGAGAGTCCGGGAAGTCATGGTCGCCCGAAAAATCACCTTCTACTGG
GTGGATACCACCGAATGGTCTAAGTTGTGGGAATCCCCAGACCACCTTGGATACTGGACTGTTTGTGAAC
TGCTCCACCACGGAGGTGGCACTGTCTTGCCATCTGAATCTTTCAGCTGGGATTTTGCTCAAGCTGGGA
AATGCTGCTCAGGAGTGGAATAAAGCTGTCAAGTGAACCTCATCTTTCTCCGTGGATTTCAATGCTGCCA
ACTGATGCCACTTTAAACCGTTTGCTCTACAATTCTCCTGAGTATGAGGCCTCGTTTCCACGAATGGAAG
GAATGTTATTTCTCCCTGTTGAAGCAGGCAAAGAGATTCAAGAAACATGGACAGTCACCCTAGAGCCCTT
GGCCATGCATCAGAGACATTTTCAGAAACCAGTCAGAATTTTTCTAAAAGGCTCAGTGGCCCAGTGGTCT
CTCCCAACGAGCAGCACTTTGGGCACTGACAGCTGGATGCTAGGAAGTCCAGAGGAGAGCACAGCAACTC
AAAGGCTGTTATTTCAGCAGTTGGTAAGCAGGCTGACTGCTGAAGAGTTACACCTGGTTGCTGATGTGGA
CCCTGGTGAAGGCCGGCCCCCCATCACTGGAGTTATTTCCCCACTCTCTGCCAGTGCTATGATCCTCACT
GTGTGCCGCACCAAGGAGGCTGAATTTCAACGACATGTTCTCCAAACAGCTGTGGCTGACAGCCCCGGG
ACACAGCTTCCCTTTTCTCAGATGTTGTGGATAGTATATTGAATCAGACTCATGATTCGCTTGCAGATAC
TGCTTCTGCTGCTTCTCCTGTTCCAGAGTGGGCCCAGCAGGAGCTTGGCCACACCACTCCCTGGAGTCCA
GCTGTTGTGGAAAAGTGGTTTCCTTTCTGTAACATCAGTGGTGCCAGTTCCGATTTGATGGAGTCATTTG
GGTTACTACAGGCTGCCTCAGCTAATAAGGAAGAGTCTTCCAAAACTGAAGGCGAATTAATACATTGCCT
TGCCGAGCTCTACCAGAGAAATCTCGTGAAGAATCCACTATAGCTCATCAAGAAGACAGCAAAAGAAA
CGAGGGGTCCCTCGTACTCCAGTGAGACAGAAGATGAATACCATGTGCCGTTCCTTAAAGATGTTGAATG
TCGCAAGGCTGAATGTGAAGGCCCAGAAGTTACATCCAGATGGCAGTCCGGATGTGGCTGGGGAGAAAGG
AATCCAAAAGATACCTAGTGGGAGAACAGTGGATAAATTGGAAGACAGAGGAAGAACACTAAGAAGTTCT
AAACCTAAAGATTTTAAAACTGAGGAAGAGCTGCTATCATATATACGTGAAAATTACCAAAAGACTGTGG
CCACAGGAGAAATCATGTTGTATGCATGTGCTCGAAACATGATCTCAACCGTTAAAATGTTCCTAAAATC
AAAAGGCACCAAGGAATTAGAAGTGAACTGCCTGAATCAAGTAAAAAGTAGTCTCTTAAAAACTAGTAAA
AGTCTTCGACAGAATCTAGGAAAAAAACTGGATAAGGAAGACAAAGTTAGAGAGTGCCAGCTTCAGGTAT
TTCTTCGTTTGGAGATGTGTCTGCAATGCCCTTCAATAAATGAAAGTACAGATGATATGGAACAAGTAGT
GGAGGAGGTGACAGATTTGCTGCGCATGGTGTGTTTAACTGAGGATTCAGCGTACCTAGCAGAGTTTCTG
```

Figure 20 (Continued)

```
GAGGAAATTTTGAGATTGTATATTGACTCTATCCCAAAGACACTTGGAAATCTTTACAACAGCCTAGGGT
TTGTGATTCCTCAGAAGCTGGCTGGTGTCCTTCCTACAGATTTTTTCAGTGATGACTCCATGACACAAGA
GAACAAATCACCACTTCTTTCTGTGCCTTTTTTGTCAAGTGCTCGTAGATCAGTGTCAGGCAGCCCTGAA
TCTGATGAACTGCAGGAACTTCGTACCAGATCAGCCAAGAAGAGAAGGAAAAATGCATTAATAAGACATA
AAAGCATTGCTGAGGTTTCACAGAATCTTCGACAAATTGAAATTCCTAAAGTGTCAAAGAGAGCTACGAA
AAAAGAGAACTCTCACCCTGCTCCTCAGCAGCCTTCCCAGCCAGTGAAAGATACAGTGCAAGAAGTGACC
AAAGTTCGAAGAAATCTTTTCAACCAGGAATTGCTTTCCCCTTCAAAGAGATCACTAAAGCGGGGGTTGC
CTAGAAGCCATTCTGTGTCAGCTGTGGATGGTCTAGAGGATAAACTTGACAACTTCAAGAAGAACAAAGG
TTATCACAAACTGCTGACTAAGAGTGTGGCCGAGACTCCAGTGCATAAGCAGATCTCCAAAAGGCTGCTG
CACAGACAAATCAAGGGCAGGTCCTCTGATCCTGGTCCTGATATTGGTGTTGTTGAAGAGTCCCCTGAAA
AAGGAGATGAAATAAGTCTGAGACGAAGTCCTCGAATCAAGCAGTTGTCATTTAGCAGGACACATTCTGC
CTCCTTCTATTCTGTGTCTCAGCCGAAGTCTCGAAGTGTGCAAAGAGTCCACTCTTTCCAGCAAGATAAG
TCAGACCAAAGAGAAAATTCTCCAGTCCAAAGTATTCGGTCTCCCAAGAGTCTTCTTTTTGGGCAATGT
CTGAGATGATCAGCCCCTCAGAAAAGGGTTCAGCTCGAATGAAAAAGCGTTCAAGAAACACTTTGGATTC
GGAGGTACCTGCAGCTTACCAGACTCCCAAGAAGAGTCACCAGAAATCTCTGAGCTTTTCTAAAACTACA
CCAAGAAGGATCTCTCATACACCACAAACTCCGTTGTATACTCCAGAAAGGCTGCAGAAGTCCCCTGCAA
AAATGACCCCTACAAAGCAGGCAGCTTTTAAGGAGTCCTTAAAAGACTCCTCCTCACCCGGCCATGACTC
ACCATTGGATTCAAAAATCACTCCTCAAAAACGACATACCCAGGCAGGAGAAGGTACCTCTCTTGAAACG
AAGACACCAAGAACTCCTAAGAGGCAAGGTACTCAGCCGCCTGGGTTTTTGCCAAACTGTACTTGGCCAC
ATTCAGTGAATTCCAGTCCAGAAAGCCCCTCCTGTCCAGCCCCTCCAACTTCATCGACTGCCCAGCCCAG
GAGAGAGTGTCTCACTCCCATCAGAGACCCTCTCAGAACACCTCCGAGAGCAGCAGCCTTCATGGGCACG
CCTCAGAATCAAACACACCAACAGCCCCATGTCCTCAGAGCTGCTCGGGCAGAGGAACCAGCCCAGAAAC
TAAAGGATAAAGCTATCAAAACTCCAAAAAGACCAGGGAATTCAACTGTGACTTCTTCCCCACCTGTTAC
GCCAAAGAAACTGTTTACCTCTCCTTTATGTGATGTCTCCAAGAAGAGTCCATTTAGGAAATCTAAAATA
GAGTGTCCTTCCCCAGGAGAACTGGATCAGAAAGAGCCCCAGATGTCACCCAGCGTAGCTGCATCTCTCT
CCTGCCCTGTTCCCTCAACTCCCCCTGAACTCTCACAGAGAGCTACATTGGACACCGTCCCTCCTCCACC
CCCTTCTAAAGTTGGGAAACGGTGTAGAAAGACCTCTGATCCCAGAAGGAGCATCGTGGAGTGTCAGCCT
GATGCCTCCGCTACTCCTGGGGTTGGCACAGCTGACAGCCCAGCTGCCCCCACAGACTCTAGAGATGACC
AGAAGGGACTGAGCCTCTCTCCTCAGTCTCCTCCTGAAAGACGGGGCTACCCAGGCCCTGGTCTCAGGAG
TGATTGGCATGCATCCTCTCCTCTGCTCATTACAAGTGACACAGAGCATGTCACTCTCCTCAGTGAAGCC
GAACACCATGGCATTGGTGACTTGAAAAGTAACGTCTTATCAGTGGAAGAGGGTGAGGGGCTAAGGACAG
CAGATGCTGAGAAGTCTTCTCTGTCTCACCCTGGGATTCCCCATCTCCTCCTTCCTGTGGGCCTGGCTC
TCCTCTGATGCCTTCCCGTGACGTGCACTGTACCACAGATGGGAGACAGTGCCAGGCTTCGGCACAACTA
GACAACCTGCCAGCATCAGCTTGGCATTCCACAGACTCTGCCAGCCCACAGACCTATGAGGTTGAGCTGG
AGATGCAAGCTTCTGGCCTTCCCAAACTTCGAATTAAGAAGATAGACCCCAGCTCTTCATTAGAGGCTGA
GCCCCTCAGCAAGGAGGAGAGCTCTCTGGGAGAAGAGAGCTTCCTCCCTGCTCTCAGCATGCCCAGGGCC
AGCAGGTCCTTAAGCAAACCTGAACCCACCTATGTGTCACCCCCCTGCCCCGCCTCTCCCACAGCACAC
CTGGCAAGAGCAGGGGGCAAACCTACATCTGCCAGGCCTGTACCCCCACCCACGGCCCTTCTAGTACCCC
CTCTCCATTTCAAACAGATGGGGTTCCTTGGACACCATCCCCAAGCACAGTGGGAAGACAACTCCAGAC
ATAATTAAAGACTGGCCCAGGAGGAAGAGGGCGGTGGGCTGTGGCGCCGGCTCCTCTTCCGGGAGGGCG
AGGTCGGTGCAGACCTTCCTGGGAGCCTGTCACTGCTTGAGTCAGAGGGCAAGGACCACGGCCTTGAACT
CAGCATCCACAGGACGCCCATCTTGGAGGATTTTGAGCTCGAGGGAGTGTGCCAGCTCCCAGACCAGTCG
```

Figure 20 (Continued)

```
CCTCCCAGGAACAGCATGCCTAAGGCCGAGGAAGCCTCTTCCTGGGGACAGTTTGGGTTGAGTTCCAGGA
AGAGAGTCCTGTTGGCCAAGGAAGAAGCTGACCGTGGAGCCAAAAGGATCTGTGACCTGAGAGAAGATTC
AGAAGTTAGTAAGAGTAAAGAGGGGTCTCCAAGTTGGAGTGCATGGCAGCTACCCTCCACGGGAGACGAA
GAGGTGTTTGTTTCCGGCTCCACCCCACCTCCCAGCTGTGCCGTGCGGAGCTGCCTCTCTGCCAGTGCCC
TCCAGGCTCTGACCCAGTCTCCGCTGCTGTTCCAGGGGAAAACACCTTCCTCTCAGAGCAAAGACCCCAG
AGATGAGGATGTGGATGTTCTTCCCTCCACTGTAGAAGACTCTCCTTTCAGTCGCGCTTTCTCCAGGAGG
CGCCCCATCAGCAGAACTTATACACGGAAGAAGCTCATGGGAACCTGGCTGGAGGACTTATAGCCACAAA
CATTACTGAGCCCAAAAGATCAAGGAGTCAGCCAGGACCCTGTGGACATAAAGAAGTTGGATGCCTGGTC
CCAAGCCTCTTTTGCCATGGTCAGTGTTCAGATTGCCATTAGAATGCCTTAGGGTTTTCTAATTCCCCTT
ATGGATCCAATCCATCTCCTGGCCCTGCCCCTTGTTGGGGAAGTTGCAGGAGGAGAGGTGGATGGCAATG
TGATTGGTGCTATAACTCAGGCAGCCTGGGAGTCAGGAACCCAGACAAGGAATCCCATTCCAGCCTCACC
CCAACCATGACCTTGGCAAGTCAGGGGGCCACTCTGCCTCATTTATGCAAATGGAGAAAGGCGCCCTCCC
TGGGGTCCCTTGAGCTGCTGTAAGGCTGGGCTGCTGCGACACAGGCAGCGCTTTGTAAACTGTGAAGCCA
TATACGTGAAACTGAAGAGTGCATTGGGCAGTGGAAGCTATTTTTGCCTTCCCTGTGTAACAGTAAAAT
CATCTCTAGTGACTGAGCACTCAGTACATTTTTGTTTAATGTTGGGCCTGAGGTTAACTGTGACCATGGT
CCAGCTTGAGTGGCTTCTGGAGCAGCCACATTTTCAAGGACTGTCCAAGAGCCAGCCAGTTCAGGGCTCA
GGCCTCACCCATTGCCCACTCCTGGGGAGACCATCACCTGGCTCATCGTTTCCACCAAGAGTGCCCCACA
GGAGTGCCCCACAGACCCGCTGGACCAGCCTGCTGCGGGTCCTGGCCAGGGGTCTGGCTAACGGTGAGGG
CTGACTCTGAACTGTCTCTCAGTCTCCAGAAAGTGTTCAAGCCTGTTGTGTTCCCAAATCTGATTCCTCC
TATTGTCTTGTAAATCAAACTCTAAGTGAAAACTTCCCATTTGTCCCTTCAAAGATTTTTTTTATTAAA
TGGTTTTTTAAGATCCTAAAAAAAAAAAAAAAAAAAAAA

>gi|22749516|ref|NM_152772.1| Homo sapiens t-complex 11 (mouse)-like 2 (TCP11L2),
mRNA
GGGACACTGGGGCTGGGGGGGTTTGTTGGGCTGGTGAGTTTTCGAGGTGACTGTGCTGTGCTCGGTGAGG
GGACGCCCAGAGAGCCCTGACCCGGGGTCACTCCGTCGCCGTTCTCCTCTTGTCTACGTGCTGGACCCGG
TGCTACCTTTTTACCCACACTTAAGTGACGCAAAATGCCCTTCAATGGCGAGAAGCAGTGTGTGGGAGAG
GACCAGCCAAGCGATTCTGATTCTTCCCGGTTTTCCGAAAGCATGGCTTCGCTCAGTGACTATGAATGCT
CCAGGCAGAGCTTTGCAAGTGACTCCTCCAGCAAATCCAGCTCTCCTGCTTCAACAAGCCCTCCAAGGGT
TGTAACATTTGATGAAGTGATGGCTACAGCAAGGAACTTATCAAACTTGACTCTTGCTCATGAGATTGCT
GTAAATGAGAACTTTCAATTGAAACAAGAGGCTCTCCCAGAAAAGAGTTTGGCTGGTCGAGTGAAGCACA
TTGTTCACCAGGCCTTCTGGGACGTCTTGGATTCAGAACTAAATGCTGACCCTCCTGAGTTTGAACATGC
CATCAAACTGTTTGAAGAAATCAGAGAGATTCTTCTCTCTTTTCTCACTCCCGGTGGCAACCGGCTTCGC
AACCAAATCTGTGAAGTTTTGGACACAGACCTCATTAGGCAGCAGGCTGAGCACAGTGCTGTTGACATCC
AAGGCCTGGCCAACTATGTCATCAGTACGATGGGAAAGCTGTGTGCTCCCGTGCGAGATAATGATATCAG
AGAGTTAAAGGCTACTGGCAACATCGTGGAGGTGCTGAGACAAATATTCCATGTCCTGGACCTCATGCAA
ATGGACATGGCCAATTTTACAATTATGAGTCTCAGACCGCACCTTCAACGCCAGTTGGTGGAATATGAGA
GAACCAAGTTCCAGGAAATTTTGGAAGAAACTCCAAGTGCTCTTGATCAGACTACAGAATGGATAAAAGA
ATCTGTAAATGAAGAATTATTTTCTCTTTCTGAGAGTGCTTTAACTCCTGGGGCCGAAAATACCTCCAAG
CCAAGCCTGAGCCCTACTTTGGTGCTAAATAATAGTTACTTGAAACTGTTACAGTGGGATTATCAGAAAA
AAGAATTACCAGAGACACTTATGACAGATGGAGCACGTCTTCAGGAACTAACAGAAAAGCTGAATCAATT
GAAAATTATTGCCTGCCTGTCCCTAATTACCAACAACATGGTGGGTGCTATTACAGGAGGCCTGCCTGAG
```

Figure 20 (Continued)

```
CTTGCAAGCAGGTTAACAAGGATTTCAGCTGTTCTACTTGAAGGCATGAACAAAGAGACCTTTAACTTGA
AGGAAGTCCTGAATTCTATTGGTATTCAGACTTGTGTTGAGGTTAACAAGACCCTGATGGAAAGAGGTTT
ACCCACTTTAAATGCTGAGATTCAAGCTAATCTTATAGGTCAATTTTCAAGCATTGAAGAGGAGGACAAT
CCTATCTGGTCCTTGATTGATAAACGAATTAAGCTTTACATGAGAAGGCTACTTTGTCTTCCAAGCCCTC
AAAAATGCATGCCTCCTATGCCAGGAGGCCTAGCTGTCATTCAGCAGGAGCTAGAAGCCCTAGGCTCTCA
ATATGCAAACATTGTGAATCTCAACAAACAAGTGTATGGACCATTTTATGCAAATATACTTCGAAAGCTG
CTCTTCAATGAGGAAGCCATGGGGAAGGTAGATGCTTCACCTCCTACTAACTAAAGAAGAACTGACATTG
GACGAGAGATTGGAAATCCAGTACTTTGGTATCCAGTCCACTTCCATTGATGGCATTAGAGATCCAGCAC
ATTCTCAGTACTGTGGTGCAGTATTAGCCCAAATCTGTGTAATGGGTAATATTAGCATTACAGAAGACAC
ACACATCACATAGACCCTCAGAAGACGTAAACATCACATAGACCCTATTTGTGCATCATTTTCAAGTTTA
AAACAGATATTTGTAATGAACAGAAAACAATTTGTAATTAATTATATTACCTATATAATACTTGTAAATG
TTTTCTTAACCATTTATATTTGGCTTATGACATTTAACCCCTAAGGAGTTGTTTTTCTCACTTGTTATTA
TCAAACCTAATGGTTTTTAATTTTGGTACAACTCCTTAAAGGGTTGAAGGTTGTGACAATAACTGAGGGA
ACTGATGTTCTGAATAAATGATGTGAAGTAAACACAATTGTATTTGAAAAAAAAAAAAAAAAAAAAAAAA
AAA

>gi|91206455|ref|NM_152789.2| Homo sapiens family with sequence similarity 133,
member B (FAM133B), transcript variant 1, mRNA
GCGGAGTGGGGAGGCGGCAAGAGGACCTGCGGCAGGCCCTCTTCGGCAGTCTCTCCGGCCCGGTTTCCCT
CGGCGTGCTACTGTGCGCTCGATCCAGCACCATGGGGAAGCGGGACAATCGGGTGGCCTATATGAACCCA
ATAGCAATGGCGAGATCAAGGGGTCCAATCCAGTCTTCAGGGCCAACAATACAGGATTATCTGAATCGAC
CAAGGCCTACCTGGGAAGAAGTAAAAGAGCAACTAGAAAAGAAAAAGAAAGGCTCCAAGGCTTTGGCTGA
ATTTGAAGAAAAAATGAATGAGAACTGGAAGAAAGAACTGGAAAAACACAGGGAGAAATTGTTAAGTGGA
AGTGAGAGCTCATCCAAAAAAAGACAGAGAAAGAAAAAAGAAAAGAAGAAATCTGGTAGGTATTCATCTT
CTTCTTCATCAAGCTCTGATTCTTCCAGCAGTTCTTCTGATTCTGAAGATGAGGATAAGAAACAAGGAAA
ACGGAGAAAGAAAAGAAGAACCGTTCACATAAATCTTCTGAAAGCTCCATGTCAGAAACTGAATCAGAC
AGTAAGGATAGTTTAAAAAAGAAAAAGAAGTCAAAAGATGGAACTGAGAAAGAAAAGGATATTAAAGGAC
TCAGCAAAAAGAGAAAGATGTATTCTGAAGATAAACCTTTATCATCTGAGTCCTTGTCAGAATCAGAGTA
TATTGAGGAGGTGCGAGCAAAAAAGAAGAAAAGCAGTGAAGAACGAGAAAAAGCAACAGAAAAAACAAAA
AAGAAAAAGAAGCATAAGAAACACAGTAAGAAGAAGAAAAAGAAGGCTGCTAGTTCAAGTCCTGACTCAC
CATAACATTAAGAAAAATCAGGATTCCCTTATAAAGAAAGTGCAATGTCTGAGGAAATTTCAACTGTGAA
AACTACAACATATTTACTAAAATGCATGAATTTTCTTGTTTTTGGAATTATTCCTGGACTATTCAGTAGC
CACTCAGATGCCACTGTGTGAAAGGGCCATAAATGTTGCCTGCTGCTTGAACATCTATTTTTTTCTCTTC
CAGTGCTTGATAACTCTGGGAGATAATACACTGCAGTCGTACTAGTGGTTAAGATATTTGGGAATAAAAT
TAATACTTTTGACTAGAAGCGTCTAAGGATAAACCAACAGAAATTGAATCTGGATACATCTTTAAGATGT
AATCAGAAATGACCAGATGACTCTAGTTAGAATTTTTGAAGGAGGGATTACATTAATATTTCAAAACCCT
TACTCTGTAGATAAGTGTATTTAATTTTTTCCCCTCGTATACTTTTATTTACCTGGGGAAGGAGCTTTT
AGGGTTGGGGGGTGGTTTGCTATCTCTTTAGCTAGCAGAATAGTGTGCCTTTGATCCTCACACATCCTGT
ATTATGGACACAGTAGCCATGCTTCACGGGGAGGTCAGAGCTGGCTACCAGCAGTCTTGCCCTTTACTGA
GCTTAGTGTCATCTTTGGATGCTGTCATATGCTGCTTTGAGTGAACCAGAGAAACAGCCATTTGCAGCAT
GAGAAAGCCCCAAAAGCTCTGGGATTTACCTCCACTTTAGTAATAATGAATATTTTTAGCATTAGAATG
TGTTATGTCATTTGAATTAATTTTGACTACACTTTGGCTTGGGAGAGGAATTATTTTAAATAGACATTGG
```

Figure 20 (Continued)

```
TACTTTTTGAACTTGATAGCTAAAGATTCTAAAATGCATGTTTTATACTAAGTTTTAACCAGTCAGGAAA
ATTTTATGTAACTAGTGATAGTTTATTTTTTTGTATGAATTTTGTTTAGGCTGCAATGTTTAGCTTTTGT
TAACTCCTCACTCTTGCTGTCTTAAGTTCATTACTATGTTTAATGGCCTACTTGCCAAGATATTTAGCAT
GTAAAAAGCAGGGTTTTGATTAAAAAAAAAAAACGGCTTCATATTGAAGCTGAGACTTACAATAACAAGT
TGAGTGGCAAGCCTGGTATGCTGTGTCTTATTGCCAGAATCTTAGTAAATGTAATGTTTTAAAAGTTTGT
TGTCTTTGTATATTAATAACAAATTATGACAAGTTAAGTTTAAATAAGAGTTACATTATTGCTCTCCCTG
TGTCATATTTTACTAAGATTTTGTGCCTCATGTCTACTGCTGAATTGTTTACTAGGAATGTTAAAAGGAA
TTGATAATTCATTTTCATTTTACATTTTTATATAATCAGGTAACATGACATACAACTTGATGTACAATTT
TGCCTGTTACAAAGGGTGTGCTAATTATAGTGGTATATGCACAGAACATGTTGGCATGACAACAGGCTGA
ATAAATAGCTATTTTACTTAAAAATAGCTGTGTTCTTATCAGCTCCCTTTGGACTGCAA

>gi|50557649|ref|NM_173192.2| Homo sapiens Kv channel interacting protein 2
(KCNIP2), transcript variant 3, mRNA
AAAGGGTGGGGGGCGGGGGTAGGGGGAGCCAATCCCGGCAGCGCCAAAGAGGGGAGGAGGCGGTGACAGC
CGCGGGGAGGGGGCGGGAGGAGAGAGGCAGCTCGGCTCGGCTCCGCGCTCAGCTCCGCTCTGCCTCCGGC
TCTGCGCTCACCTGCTGCCTAGTGTTCCCTCTCCTGCTCCAGGACCTCCGGGTAGACCTCAGACCCCGGG
CCCATTCCCAGACTCAGCCTCAGCCCGGACTTCCCCAGCCCCGACAGCACAGTAGGCCGCCAGGGGCGC
CGTGTGAGCGCCCTATCCCGGCCACCCGGCGCCCCCTCCCACGGCCCGGGCGGGAGCGGGGCGCCGGGGG
CCATGCGGGCCAGGGCCGCAAGGAGAGTTTGTCCGATTCCCGAGACCTGGACGGCTCCTACGACCAGCT
CACGGGCCACCCTCCAGGGCCCACTAAAAAAGCGCTGAAGCAGCGATTCCTCAAGCTGCTGCCGTGCTGC
GGGCCCCAAGCCCTGCCCTCAGTCAGTGAAAACAGCGTGGACGATGAATTTGAATTGTCCACCGTGTGTC
ACCGGCCTGAGGGTCTGGAGCAGCTGCAGGAGCAAACCAAATTCACGCGCAAGGAGTTGCAGGTCCTGTA
CCGGGGCTTCAAGAACGAATGTCCCAGCGGAATTGTCAATGAGGAGAACTTCAAGCAGATTTACTCCCAG
TTCTTTCCTCAAGGAGACTCCAGCACCTATGCCACTTTTCTCTTCAATGCCTTTGACACCAACCATGATG
GCTCGGTCAGTTTTGAGGACTTTGTGGCTGGTTTGTCCGTGATTCTTCGGGGAACTGTAGATGACAGGCT
TAATTGGGCCTTCAACCTGTATGACCTTAACAAGGACGGCTGCATCACCAAGGAGGAAATGCTTGACATC
ATGAAGTCCATCTATGACATGATGGGCAAGTACACGTACCCTGCACTCCGGGAGGAGGCCCCAAGGGAAC
ACGTGGAGAGCTTCTTCCAGAAGATGGACAGAAACAAGGATGGTGTGGTGACCATTGAGGAATTCATTGA
GTCTTGTCAAAAGGATGAGAACATCATGAGGTCCATGCAGCTCTTTGACAATGTCATCTAGCCCCCAGGA
GAGGGGGTCAGTGTTTCCTGGGGGGACCATGCTCTAACCCTAGTCCAGGCGGACCTCACCCTTCTCTTCC
CAGGTCTATCCTCATCCTACGCCTCCCTGGGGGCTGGAGGGATCCAAGAGCTTGGGGATTCAGTAGTCCA
GATCTCTGGAGCTGAAGGGGCCAGAGAGTGGGCAGAGTGCATCTCGGGGGGTGTTCCCAACTCCCACCAG
CTCTCACCCCCTTCCTGCCTGACACCCAGTGTTGAGAGTGCCCCTCCTGTAGGAATTGAGCGGTTCCCCA
CCTCCTACCCCTACTCTAGAAACACACTAGACAGATGTCTCCTGCTATGGTGCTTCCCCCATCCCTGACC
TCATAAACATTTCCCCTAAGACTCCCCTCTCAGAGAATGCTCCATTCTTGGCACTGGCTGGCTTCTCA
GACCAGCCATTGAGAGCCCTGTGGGAGGGGACAAGAATGTATAGGGAGAAATCTTGGGCCTGAGTCAAT
GGATAGGTCCTAGGAGGTGGCTGGGGTTGAGAATAGAAGGGCCTGGACAGATTATGATTGCTCAGGCATA
CCAGGTTATAGCTCCAAGTTCCACAGGTCTGCTACCACAGGCCATCAAAATATAAGTTTCCAGGCTTTGC
AGAAGACCTTGTCTCCTTAGAAATGCCCCAGAAATTTTCCACACCCTCCTCGGTATCCATGGAGAGCCTG
GGGCCAGATATCTGGCTCATCTCTGGCATTGCTTCCTCTCCTTCCTTCCTGCATGTGTTGGTGGTGGTTG
TGGTGGGGGAATGTGGATGGGGGATGTCCTGGCTGATGCCTGCCAAAATTTCATCCCACCCTCCTTGCTT
ATCGTCCCTGTTTTGAGGGCTATGACTTGAGTTTTTGTTTCCCATGTTCTCTATAGACTTGGGACCTTCC
```

Figure 20 (Continued)

TGAACTTGGGGCCTATCACTCCCCACAGTGGATGCCTTAGAAGGGAGAGGGAAGGAGGGAGGCAGGCATA
GCATCTGAACCCAGTGTGGGGGCATTCACTAGAATCTTCAATCAACCTGGGCTCTCCCCACCCCACCCCA
GATAACCTCCTCAGTTCCCTAGGGTCTCTTCTTGCTTGACTCAATCTACCCAGAGATGCCCCTTAGCACA
CCTAGAGGGCAGGGACCATAGGACCCAGGTTCCAACCCCATTGTCAGCACCCCAGCCATGCGGCCACCCC
TTAGCACACCTGCTCGTCCCATTTAGCTTACCCTCCCAGTTGGCCAGAATCTGAGGGGAGAGCCCCCAGA
GAGCCCCCTTCCCCATCAGAAGACTGTTGACTGCTTTGCATTTTGGGCTCTTCTATATATTTTGTAAAGT
AAGAAATATACCAGATCTAATAAAACACAATGGCTATGCAAAAAAAAAAAAAAAAAAAA

>gi|206597552|ref|NM_173475.2| Homo sapiens DCN1, defective in cullin neddylation
1, domain containing 3 (S. cerevisiae) (DCUN1D3), mRNA
AGAAAGGGTTTGACTGGAGGAACCTCTGGAGCAGCTGTTGGCTGGCTCCTCTGGCTGATGGCATGTTGAG
GTACATGGGCCAGCGGCAGCGAGGGCATCCAATCCAGAGGGGTCCACTCTAGAGGCCAGGCCACCAGCAC
CATGGGCCAGTGTGTCACCAAGTGTAAGAATCCCTCATCGACCCTGGGCAGCAAAAATGGAGACCGTGAG
CCCAGCAACAAGTCACATAGCAGGAGGGGTGCAGGCCACCGTGAGGAGCAGGTACCACCCTGTGGCAAGC
CAGGTGGAGATATCCTCGTCAACGGGACCAAGAAGGCCGAGGCTGCCACTGAGGCCTGCCAGCTGCCAAC
GTCCTCGGGAGATGCTGGGAGGGAGTCCAAGTCCAATGCCGAGGAGTCTTCCTTGCAAAGATTGGAAGAA
CTGTTCAGGCGCTACAAGGATGAGCGGGAAGATGCAATTTTGGAGGAAGGCATGGAGCGCTTTTGCAATG
ACCTGTGTGTTGACCCCACAGAATTTCGAGTGCTGCTCTTGGCTTGGAAGTTCCAGGCTGCAACCATGTG
CAAATTCACCAGGAAGGAGTTTTTTGATGGCTGCAAAGCAATAAGTGCAGACAGCATTGACGGAATCTGT
GCACGGTTCCCTAGCCTCTTAACAGAAGCCAAACAAGAGGATAAATTCAAGGATCTCTACCGGTTTACAT
TTCAGTTTGGCCTGGACTCTGAAGAAGGGCAGCGGTCACTGCATCGGGAAATAGCCATTGCCCTGTGGAA
ACTAGTCTTTACCCAGAACAATCCTCCGGTATTGGACCAATGGCTAAACTTCCTAACAGAGAACCCCTCG
GGGATCAAGGGCATCTCCCGGGACACTTGGAACATGTTCCTTAACTTCACTCAGGTGATTGGCCCTGACC
TCAGCAACTACAGTGAAGATGAGGCCTGGCCAAGTCTCTTTGACACCTTTGTGGAGTGGGAAATGGAGCG
AAGGAAAAGAGAAGGGGAAGGGAGAGGTGCACTCAGCTCAGGGCCTGAGGGCTTGTGTCCCGAGGAGCAG
ACTTAGTGGCTCTGTCCCAGGAGCAGCAGCAAGGATCTGCCAGCTGCCCTGCAGCCAACTGAGGAATTGG
ACCATTTTGGAAATTACTGAAGATCCGGATATTTTCTACTTTACACCTTTCTCTGCCTTGTATCTGAAAG
GGCTCTAAAATGCTGTATCATGTTTTAGGCACTTTCTTCATTTTTTGGTTATTTTGGTTATTTCCTTTT
TGGGGGGATCTCCCAGAATATTTGAACCTGGTTACATGTGTGTATCTTTTTTGAAGCCTTCAGATAGA
ATAAGCCTGCCATTTCTTGCACAAATTTAGGTTTTTTTTTGTTTTTTTTGTTTTTTTTTTTTTTTT
TGGTAGGGGAGGGCATAGAGCAGGGCGGGGGATGGGACTGTTAGGTTGAATTAACATTACAAAATGATA
CAGTGCCAGATCTCAGTTTCGCATATTGTTTTTCAGGGCAGGTCTGTACTGTGTGTAGTGCTGTTTACAT
AGATGAATTTAGGTTGTAATAATTATTTTTAAAGATTTACACAGATTTGAATAGCAGTGTTAACTGTTAA
CCACATTGCATTAATTCCCAGGCGATTTAGAGCTCTTGGAGAGCCAAGGCCAGCCAAGAGCATTTGTAGT
CTGGTGACAACCCCCTTTTAAGCTAATTTATCCAGAACCCTGATTTCCCTCACTTCTTGCTCATTCCTTC
TTTGACCTATTGCATTTCATGTTGAGTTTTTCCATCAACATGCTGCACCTGTCAGTCAAGTGAGCATTTT
TTAAGAACACATTGTACTGAGAACCACTTAAGCATTGAATGCGAGAAAGCAGTGCTACCTCAGTTTTGC
TGGAAGTAGACTTCTTTGATAGTTTTCTTTCTTTGATGAAGTTTCTGTATTTTCATGTTGTAAGTGGAAA
TACTTTTTTTTGTTTGTTTGTTTCATTTGCCTTGGAGCCAAAGTTTCTGTTCCTGGTGGTCGGGAAACTG
CCTGCCGGCCAACTGACTTGAAGGAAAACTGTGGTATGGAGCTCTGCTTGAATTTTTTTTTTTTAATAT
TTTTATTTTTTTCTTTGAATATCATCAGCTTACTTGTCTGGCAAGGGCAGAAGCCTGGGGTTGGCCTGAA
CTCTGCCAAACAAATATCAAAGTGTATTTAATAGTTAAATTTGTGCCCTTTCCCTTCTTGCTGCACCCAT

Figure 20 (Continued)

```
GTTGTCACTTAACCCCCAGGAGTTATTTATTATCTTTTTGTTAAAGTCAGGCTCATTTGGGGTAATGTGA
TGACTGTTTAGGTTTACATGACCCTCCTCTCCTTTCCCTACCCCCAAATATGTATATATACATATATAAA
ATATGTATATATTTTACCTATATAAAATATATATATATACACATATATGTATCTATATTCCTTTGTTTCT
TTGCCTGCTTATACTGGCCATAAAAGAGGGAGCTGCCTTCAATGTATAAAGTATAAGAAGAGTGCCAGGG
AATGCCATAATGGAGGCTTTTGGATCTGAATTTGGACCATTTCACTAAAGAGAACATGAGTTTGCTCAGC
CCTTTCCTCACAAGAGGGAGGGCCCCGGTTCCCAGACTTCTCCACGCGCTGGCTCCATAAAGGCCAGCT
TTGGCCAGGCTGCCACAGGGGCCTGAGGAGCTCACTCTGGGCCTACCTGGTTTCAGTTAGAGGGTCCTCC
TGTTATTTTTCCATTTAAAAAGTATGTCCTCAGAAAACTGTACTGGAAGGATGGGTGGCAGGAACTTGTA
TAGTTCAGCTTCCAACACTTTGGAACAGATTAAAAAGGGAATCTTTTAAATAAAAACGTATAAAAATAAA
AAAAAAAAAAAAAAA

>gi|122114659|ref|NM_173571.2| Homo sapiens cancer/testis antigen family 47,
member A11 (CT47A11), mRNA
ACCAGAATCTTTCCCAACTTGTCTAAGTCCTCTCAGGCCAGCCTTGGTGGGAGGTTTCTAGGATTCGCTC
CCTGCCCTTCCCATCTTAGGGTGTCGTCTGAGACAGACTCTTATTCCCTCAATAAAGAGAGAGACTCTTA
TTCCCTCAGCGGCCAGCTCCTCGCCTCCCCTCGGCCGTAGCCACCTCAGTGGTCACCGTCTTCACCGTGG
TCGCCTCAGCCCGCTCGCCACCCCAGTTGAGGCGCTGCTGGTGTCATGTCTGCCACAGGGGACCGACACC
CGACCCAAGGGGACCAGGAGGCCCCGGTAAGCCAGGAGGGAGCACAGGCCGAGGCGGCCGGAGCTGGTAA
CCAGGAGGCGGCGACTCCGGCCCCGACAGCAGCGACGTGGTGCCTGCGGCCGAGGTGGTCGGAGTCGCA
GGGCCCGTGGAAGGCCTCGGGGAGGAGGAGGGTGAGCAGGCGGCAGGCCTGGCCGCAGTCCCCCGGGGCG
GGAGCGCCGAGGAGGACTCAGATATCGGGCCCGCGACGGAGGAAGAGGAGGAGGAAGAGGGGAACGAGGC
GGCCAACTTCGACTTGGCGGTGGTCGCCCGTCGCTACCCGGCGTCGGGCATTCACTTCGTGCTCCTGGAC
ATGGTCCACTCCCTTCTCCACCGCCTCTCTCACAACGACCACATCCTCATAGAGAACCGTCAACTCAGCC
GCCTGATGGTGGGGCCACACGCTGCTGCGCGCAACCTCTGGGGCAACCTCCCCCCGCTGCTGCTGCCCCA
GAGGCTGGGTGCAGGGCCGCAGCCCGGGCGGGCGAGGGCCTGGGCCTGATCCAGGAGGCCGCATCGGTC
CCAGAGCCTGCAGTGCCAGCTGACCTGGCCGAGATGGCCAGGGAGCCCGCGGAGGAGGCCGCAGAGGAGA
AGCTCTCAGAGGAGGCCACAGAGGAACCAGACGCAGAGGAACCGGCCACAGAAGAACCGACCGCACAGGA
GGCCACGGCCCCAGAGGAAGTCACTAAATCTCAGCCCGAAAAGTGGGATGAAGAGGCCCAAGATGCTGCA
GGCGAGGAAGAGAAAGAACAAGAAAAAGAGAAGGATGCGGAAAACAAGGTGAAGAACTCCAAAGGGACCT
AGACGCAGCAGAGGTGAAGCCAAGAAAATCCAGATGCCTGTGGGAATTGTAACACATATCATTCCAAAGT
TCGTTACATCAAAAGTGATATCCAGTGACATCTAACTTTCATGGATGTATGTGACAGTGTTCAAGTTAAA
AAATAAAGTTTGTTTTAAATGAATAAACTGAAA >gi|31341191|ref|NM_173850.2| Homo sapiens serpin peptidase inhibitor, clade A
(alpha-1 antiproteinase, antitrypsin), member 12 (SERPINA12), mRNA
CTCCCAGGTGCCTGGCAGAGAGTCCTCACCAGCCCCTGCCGGATGTCTGGCTGGCATCTGAGGGGACTG
AACATGGCAAGAAGCAAAACAGCAGCACAAGAAACCAGTTTCTTCATCTGAAACCGAGCAGGCTCTACTC
CAGAACAGAACCCACAGTCCCAGGCGCTGGGCCTTCTTCTTAAGTTGGGAAATCACTCATCCCCAGGAGA
AAAAAGAGCAAAAGCTTCCAGTACTGGGGATGTGGGGAGAGGTTTTTAAAAATATCAGCCCAATATAT
GGGAAAATATGGGATGCAGGCATCCCCAGGTGTCAAGCGTCCAGATCCGTAGACACACTGGGACGATGGT
GATCAGTATCACTCCCTCTGACTCATCGGCCCTACAGAGAAGACACCATGCTGGTGCACAGTCGGTGCCA
AACCCGCGTTTGTAAATGAATAAGTGTTGCTGCCCTGGTGGAAGCCCAGCTCATGTGGAGGAAGCCAGCT
```

Figure 20 (Continued)

```
TGCAGAGAGAGCAAGAACAGAGCCAGCACACACATTGGAGCAAAGGCAAGGGCAGATGGAAAGTTCTGGC
GGCATCATGCCAAGGCTCCCATCCGAGGCCTCCCTGAACCCCACTCTCTCGGCGCCACCTTGGATGCTGC
GGGCTGGTACATTCCCCACTTGCAAAACTCTGTGGGGCTGGGTTCCTCTCTTTTCTTTCCAAATATCCCA
GGAAGTGGATGGTTTTATCCAAATTCAGCAGACGAGTAAAAAGAGTCTTCGGGAGGTGCAATAGCTTTCT
AGGAATGAGGATATTCTTCAAGGAAAATGAACCCCACACTAGGCCTGGCCATTTTTCTGGCTGTTCTCCT
CACGGTGAAAGGTCTTCTAAAGCCGAGCTTCTCACCAAGGAATTATAAAGCTTTGAGCGAGGTCCAAGGA
TGGAAGCAAAGGATGGCAGCCAAGGAGCTTGCAAGGCAGAACATGGACTTAGGCTTTAAGCTGCTCAAGA
AGCTGGCCTTTTACAACCCTGGCAGGAACATCTTCCTATCCCCCTTGAGCATCTCTACAGCTTTCTCCAT
GCTGTGCCTGGGTGCCCAGGACAGCACCCTGGACGAGATCAAGCAGGGGTTCAACTTCAGAAAGATGCCA
GAAAAAGATCTTCATGAGGGCTTCCATTACATCATCCACGAGCTGACCCAGAAGACCCAGGACCTCAAAC
TGAGCATTGGGAACACGCTGTTCATTGACCAGAGGCTGCAGCCACAGCGTAAGTTTTTGGAAGATGCCAA
GAACTTTTACAGTGCCGAAACCATCCTTACCAACTTTCAGAATTTGGAAATGGCTCAGAAGCAGATCAAT
GACTTTATCAGTCAAAAAACCCATGGGAAAATTAACAACCTGATCGAGAATATAGACCCCGGCACTGTGA
TGCTTCTTGCAAATTATATTTTCTTTCGAGCCAGGTGGAAACATGAGTTTGATCCAAATGTAACTAAAGA
GGAAGATTTCTTTCTGGAGAAAAACAGTTCAGTCAAGGTGCCCATGATGTTCCGTAGTGGCATATACCAA
GTTGGCTATGACGATAAGCTCTCTTGCACCATCCTGGAAATACCCTACCAGAAAAATATCACAGCCATCT
TCATCCTTCCTGATGAGGGCAAGCTGAAGCACTTGGAGAAGGGATTGCAGGTGGACACTTTCTCCAGATG
GAAAACATTACTGTCACGCAGGGTCGTAGACGTGTCTGTACCCAGACTCCACATGACGGGCACCTTCGAC
CTGAAGAAGACTCTCTCCTACATAGGTGTCTCCAAAATCTTTGAGGAACATGGTGATCTCACCAAGATCG
CCCCTCATCGCAGCCTGAAAGTGGGCGAGGCTGTGCACAAGGCTGAGCTGAAGATGGATGAGAGGGGTAC
GGAAGGGGCCGCTGGCACCGGAGCACAGACTCTGCCCATGGAGACACCACTCGTCGTCAAGATAGACAAA
CCCTATCTGCTGCTGATTTACAGCGAGAAAATACCTTCCGTGCTCTTCCTGGGAAAGATTGTTAACCCTA
TTGGAAAATAAAGGAGAATTCCTGCTTGCCAAAAAAAAAAAAAAAAAAAAAAAAAA

>gi|195972891|ref|NM_174912.3| Homo sapiens fatty acid amide hydrolase 2 (FAAH2),
mRNA
GATAAACAAGCTCCTGTGGAATTGTGGGTAGACACTGGACTTGTAAACGAAAAGCTTCATAAGTCCCTCT
TTGCTTAGTACTTTTCTCGTCCTTTCCCCAGGGTGCACGTAACCCTCAAGCACTAGGACCGTGCGGAATC
CAGGCTGCGATGGCACCTTCATTTACCGCCCGCATTCAGTTGTTCCTCTTGCGGGCGCTAGGCTTTCTCA
TAGGCTTAGTAGGCCGAGCAGCTTTAGTCTTAGGGGGTCCAAAGTTTGCCTCAAAGACCCCTCGGCCGGT
GACTGAACCATTGCTTCTGCTTTCGGGGATGCAGCTGGCCAAGCTGATCCGACAGAGAAAGGTGAAATGT
ATAGATGTTGTTCAGGCTTATATCAACAGAATCAAGGACGTGAACCCAATGATCAATGGAATTGTCAAGT
ACAGGTTTGAGGAAGCGATGAAGGAGGCTCATGCTGTAGATCAAAAGCTTGCAGAGAAGCAGGAAGATGA
AGCCACCCTGGAAAATAAATGGCCCTTCCTTGGGGTTCCTTTGACAGTCAAGGAAGCTTTCCAGCTACAA
GGAATGCCCAATTCTTCTGGACTCATGAACCGTCGTGATGCCATTGCCAAAACAGATGCCACTGTGGTGG
CATTACTGAAGGGAGCTGGTGCCATTCCTCTTGGCATAACCAACTGTAGTGAGTTGTGTATGTGGTATGA
ATCCAGTAACAAGATCTATGGCCGATCAAACAACCCATATGATTACAGCATATTGTAGGTGGAAGTTCT
GGTGGTGAGGGCTGCACACTGGCAGCTGCCTGCTCAGTTATTGGTGTGGGCTCTGATATTGGTGGTAGCA
TTCGAATGCCTGCTTTCTTCAATGGTATATTTGGACACAAGCCTTCTCCAGGTGTGGTTCCCAACAAAGG
TCAGTTTCCCTTGGCTGTGGGAGCCCAGGAGTTGTTTCTGTGCACTGGTCCTATGTGCCGTTATGCTGAA
GACCTGGCCCCATGTTGAAGGTCATGGCAGGACCTGGGATCAAAAGGTTAAAACTAGACACAAAGGTAC
ATTTAAAAGACTTAAAATTTTACTGGATGGAACATGATGGAGGCTCATTTTTAATGTCCAAAGTGGACCA
```

Figure 20 (Continued)

AGATCTCATTATGACTCAGAAAAAGGTTGTGGTTCACCTTGAAACTATTCTAGGAGCCTCAGTTCAACAT
GTTAAACTGAAGAAAATGAAGTACTCTTTTCAGTTGTGGATCGCAATGATGTCAGCAAAGGGACATGATG
GGAAGGAACCTGTGAAATTTGTAGATTTGCTTGGTGACCATGGGAAACATGTCAGTCCTCTGTGGGAGTT
GATCAAATGGTGCCTGGGTCTGTCAGTGTACACCATCCCTTCCATTGGACTGGCTTTGTTGGAAGAAAAG
CTCAGATATAGCAATGAGAAATACCAAAAGTTTAAGGCAGTGGAAGAAAGCCTGCGTAAAGAGCTGGTGG
ATATGCTAGGTGATGATGGTGTGTTCTTATATCCCTCACATCCCACAGTGGCACCTAAGCATCATGTCCC
TCTAACACGGCCTTTCAACTTTGCTTACACAGGTGTCTTCAGTGCCCTGGGTTTGCCTGTGACCCAATGC
CCACTGGGACTGAATGCCAAAGGACTCCCTTTAGGCATCCAGGTTGTGGCTGGACCCTTTAATGATCATC
TGACCCTGGCTGTGGCCCAGTACTTGGAGAAAACTTTTGGGGGCTGGGTCTGTCCAGGAAAGTTTTAGGA
GGACCTTCTGCAAGGTTAATGTGTGTGTGTGTTTGTGTTCGTGTGGTGGTGTTTCTATTAATTGGGTGAA
ATCAAGCACCAGCAGACAAGCAGAGAAACAACTGGGGAATTTATTGACTCATTTAGTTATTCTTTCTACT
TTTATTTCCTTCTCTAACTGTTGGTCTTACTAAAATGGTAATATTTGCTTCTTGCTTTTATGTTACTGGA
AAATTAGGACATGTAAATGGATAAGTGCAATAAAGTTTCCTAAATGCTGGAAAAAAAAAAAAAAAAAAAA
AAAAAAAA

>gi|157427677|ref|NM_177949.2| Homo sapiens armadillo repeat containing, X-linked
2 (ARMCX2), mRNA
CTTAAAGCCCTGACCGTCGTTCTCCGTCCTCCTCTGGGTACCAACTCTATTGCGCAGCTCGCTGCCGTGC
GTTTAACCCAGGCGAGGAGGAGGAGGAGAAAATTCCCCCAGATTCGGGCAGGCCCGCACCCCACATTCCG
TCCTGTTTTGAGAGGAGGAGGGAAGAGAAATAAACGTGGCAGCGCATAGAAGGCCAGCAGGGAGACTGCT
TTCCAGACACCTCCGGCCCACACAGCCGTTCACCCCCCGTCTTTTCAGTCCTGGAAAAGGAATTCGGTCT
GTCCTTAGGATGAAGCTCTAACTGAACTGAAGTAAGGAGAAACAGCCTTGAATCTTTGGAGGGTCTGTCT
TCCTTTTGGGCTCTGTGCAACTGCAGCTACAGTGGAAAAAAGCAAACTGCTCTTGATCCCAGGCCCTGCC
TAAGCCTCAGCAGAACTTGTAAGCCTAAACTGAAGAGCCTCACCCGGACGAGCAGGCATCCCTTAACCTT
AAGCAATCCAGTTCCACGCCCTGGATCAGTGAATAACCCCAGCTGCACCATGAGCCGCGTTCGGGATGCT
GGCTGTGTAGCGGCGGGGATAGTGATAGGGGCTGGTGCCTGGTACTGTGTCTACAAATACACCAGGGGGA
GAGACCAGACCAAGAAGAGAATGGCCAAGCCCAAAAACCGGGCTGTGGCTGGGACTGGAGCCAGGGCTAG
AGCTGGGCTAAGAGCCGGATTCACAATCGACCTTGGGTCAGGATTCAGTCCCCCAACCCCAGTCCGTGCT
GAAGCAGAGGACAGGGCCCAGGATGAAGCCTCTGCTCTGGACACAGTTGGAGCTGAGGCAGTGGCCCCAG
CTGCATCCAGCGCTGAGGCTCAGAGTGGGGCAGGCAGTCAGGCCCAAGAGGCAGATGGAGCCGGGGTTGG
GCCTAAGGCCGAATCAGTAGTTGGGGCTGCAATGGCTTCTGCAATAGCACCACCTCCCGGGGTGACAGAG
GCCCTTGGGGCTGCAGAAGCCCCTGCAATGGCAGGGGCTCCCAAAGTGGCAGAAGCTCCCAGAGAAGCGG
AGACTTCCAGGGCAGCGGTGCCTCCTGGGACAGTGGTGCCTACCGAAGCGGCAGCACCCACTGAGGTGAC
CGAGGGTCCTGGGGTAGCAGCACCTACCAAGGTAGCTGAAGCTCCCGGGGTGGCATCGCCTACCGAGGCA
GCTGAGGCTCCTGTGCCCGCAACGCCTACTGGGGCTGCAGCACCTACTGGGGCTGCAGAGTCTCCTGGAA
CTTCTGGTTCCCCTAGAACAGCGGTGGTTCCTGGAACATCAGCTGCCAAGAAAGCAACCCCTGGGGCTCA
CACTGGGGCTATACCGAAAGCCACATCAGCGACTGGAGCGGTACCCAAAGGTGGAGGCAAGGGTGTAACC
AGGTCCCGGAATGGGGCAAGGGCAAGGGCAAGAAAAGCAAAGTTGAAGTAGACGAACTGGGGATGGGCT
TCCGTCCTGGAGATGGGGCTGCAGCAGCTGCTGCAGCCTCTGCTAATGGCGGACAGGCTTTCCTGGCAGA
GGTCCCTGATTCTGAGGAAGGGGAGTCCGGGTGGACTGACACAGAGTCAGATTCAGACTCTGAGCCCGAG
ACCCAGCGCAGAGGGAGGGAAGAAGACCCGTTGCCATGCAGAAGCGCCCCTTTCCTTATGAAATTGATG
AGATTCTGGGTGTCCGCGATCTCAGGAAGGTCCTTGCCTTGCTTCAGAAATCTGATGATCCTTTCATCCA

Figure 20 (Continued)

ACAGGTAGCTTTGCTCACTCTGAGCAACAATGCCAATTATTCATGCAATCAAGAGACAATCCGCAAATTG
GGAGGCCTCCCAATTATTGCAAACATGATCAACAAAACTGATCCACACATTAAGGAAAAAGCCTTAATGG
CCATGAATAACCTGAGTGAGAATTATGAAAATCAGGGCCGGCTTCAGGTGTACATGAATAAAGTGATGGA
TGATATCATGGCCTCTAACCTGAACTCAGCAGTTCAAGTAGTTGGACTAAAATTTCTAACAAACATGACT
ATTACTAATGACTACCAGCACCTGCTTGTCAATTCCATTGCAAACTTTTTCCGTTTGCTATCTCAGGGAG
GTGGAAAAATCAAGGTTGAGATTTTGAAAATCCTTTCGAATTTTGCTGAAAATCCAGATATGTTGAAGAA
ACTTCTCAGTACCCAAGTGCCAGCATCATTTAGTTCCCTCTATAATTCTTACGTGGAATCAGAAATCCTT
ATTAATGCCCTTACTCTATTTGAGATTATCTATGACAATCTCAGAGCAGAAGTGTTTAACTATAGAGAAT
TCAATAAAGGTTCCCTTTTTTACTTATGCACTACATCTGGAGTGTGTGTTAAGAAAATTAGAGCCTTAGC
AAATCACCATGACCTCTTAGTGAAAGTGAAAGTTATAAAACTAGTGAACAAATTCTGATTGGTTATGTAC
CGTCAAAAGACTTGAAGAAATTTCATGATTTTGCAGTGTGGAAGCGTTGAAAATTGAAAGTTACTGCTTT
TCCACTTGCTCATATAGTAAAGGGATCCTTTCAGCTGCCAGTGTTGAATAATGTATCATCCAGAGTGATG
TTATCTGTGACAGTCACCAGCTTTAAGCTGAACCATTTTATGAATACCAAATAAATAGACCTCTTGTACT
GAAAACATATTTGTGACTTTAATCGTGCTGCTTGGATAGAAATATTTTTACTGGTTCTTCTGAATTGACA
GTAAACCTGTCCATTATGAATGGCCTACTGTTCTATTATTTGTTTTGACTTGAATTTATCCACCAAAGAC
TTCATTTGTGTATCATCAATAAAGTTGTATGTTTCAACTGACAAAAAAAAAAAAAAAA

>gi|320202960|ref|NM_177999.2| Homo sapiens ankyrin repeat and SOCS box
containing 6 (ASB6), transcript variant 2, mRNA
GTCACTTCCGGCGGGGGCGCGGCTTGGACTGAGGAGCGGACCCGGCCGGGCGCAGGGGCTGGACTGGCGG
AGCAGGTGGGGTCCGCGGCCGCCGGAGCGTTCCGGTCGGCGTCTGGGCATCTCGGCCTCGGCAGAAAGCG
CGACCGCCCTGCTGCGCGGGCCCGCGGCGATGCCGTTCCTGCACGGCTTCCGGAGGATCATCTTCGAGT
ACCAGCCGCTGGTGGATGCGATTCTGGGCTCCCTGGGGATCCAGGACCCCGAGCGGCAGGAGTCTCTGGA
CCGGCCCAGTTATGTCGCCAGCGAGGAGAGCCGAATCCTTGTTCTCACTGAGCTGCTGGAGAGGAAAGCC
CACTCTCCCTTTTACCAGGAAGGCGTGAGCAACGCCCTGCTCAAGATGGCTGAGCTGGGGCTGACGCGGG
CGGCCGACGTTCTCTTGCGGCATGGGGCCAATCTCAACTTTGAAGACCCAGTCACCTACTACACGGCCTT
GCACATCGCCGTCCTGCGGAACCAGCCGGACATGGTGGAGCTGCTGGTGCATCACGGGGCCGACGTTAAT
CGGAGGGACCGGGAAAAACTGCTCTGCTCCATGCTCTGGCCAGCAGCGACGGGGTGCAGATCCACAATAC
TGAGAACATTCGTCTCTTACTGGAAGGAGGGGCAGACGTCAAGGCCACCACCAAAGATGGGGACACAGTG
TTCACCTGCATCATCTTCCTGCTTGGTGAGACCGTGGGAGGGGACAAAGAGGAGGCCCAGATGATCAACC
GCTTCTGCTTCCAAGTCACACGGCTGCTGCTGGCACACGGGGCCGACCCCAGCGAGTGCCCAGCCCACGA
GTCCCTCACCCACATCTGCCTGAAGAGCTTTAAACTGCACTTCCCTCTCCTGCGCTTCCTCCTGGAGTCC
GGAGCCGCCTACAACTGCTCCCTGCACGGTGCGTCCTGCTGGTCTGGCTTTCACATCATCTTTGAGAGGC
TCTGTTCCCACCCAGGCTGCACGGAAGACGAGAGCCATGCGGACCTCCTGCGCAAAGCTGAGACTGTCCT
GGATCTCATGGTGACCAACTCTCAGAAACTCCAGCTGCCCGAAAACTTCGATATCCACCCTGTGGGCAGC
CTGGCGGAAAAGATCCAGGCCCTCCACTTCTCCTTGAGGCAGCTGGAGAGCTATCCCCCGCCCCTCAAGC
ACCTGTGCCGTGTGGCCATCCGGCTCTACCTTCAGCCGTGGCCTGTGGATGTGAAGGTCAAAGCCCTGCC
TCTGCCCGACAGGCTGAAGTGGTACCTCCTTAGCGAGCACAGTGGCTCCGTGGAAGATGACATCTGATAG
GTCTCAGGCTACAGGAACGGGGACACGGGCAGCTCAGGTCAGCCTGTTGGTAGATGCTGGGACAGCATT
AGAAGAGGGTCTTTTTGATCGGGAGATGAGACGGGATCCTTCATGAGAAAAGCCAGCCAGGTAGAGCCT
GAAGCTGTGATCACTCCAGTGGTGAAGGGTGCAGCTCTGGTTCTTCCAGAGAGACTGCCCCCTTCCCTCC
AGCGGCACTCCAAGTCCCCCCCATGTTGGAAAGAGGAACAGGGCTTGGATTGATGTTTATACCCTCTGAA

Figure 20 (Continued)

```
TTGGAGGGCAGTGCCAGGGCATTTGCAGAAGCTGGGAAGGACCAAGCCTCAGCACCCCAGGGCTGCGGGG
CTCTTGTTGGCCGCACGTGGCAGTGCAGCTGGAGAGGAAGCCTGGGGCACGTCCTGTGCGGTGCCACCAA
GGCCCCACCCCTGCCCCTTTTCCTTCCAGGTTCTGTTACTCACAGAAGTGTTTCTGGTGGGCTCTGCGGG
AGAAGACACTAAGGGCCCCACAGGCTTGTTTCATGGTGTTGCAAGCCAAGCTGGCCCCTGCCTGTTCCTG
TAGCTCTGGGGCCAGGTCAGCCGTGGCCCCACCTACCAGAACTGTGCTCTGCTGGCAGCTGTGCTTTTGC
CAAACCCAGGGCCTCAGCGACCATGACTTCTGCTAAAAAGCAATCATGAGTGCGTGGCTGGGGACAGACC
TCTCTGAAGTGTCTCCTGTTGTGAGGGGCTCACTTTGGAGCCACTGAAGAGCCGACTGTGCCACCCACTT
GCGAGCCTCAGTCCCTTCCAAGCTGCACTGGTCATTGGGAATTGTGTAAACACCTCTGGGGATAAGCTGA
GGTGACTAAATGATATATTTATATTATAAGATTAAACTGACTTTCTTGGCCTTAACAAGGTCCTTATATA
AAATTTCCACCCCGCCCCTCCATAGTTCAGGATAGAGGCTCCCACAGCAGCCGGTAAGGAAGTGGGTGGC
AGGTGTGAGGGGATGCTGTGTTTGGGGGGTTGTTTCCAAGTCCCTGCAAAGAAGCACCACTCTAGACTGG
CAAGGGCCTCCACAGTGTGGAGGTCCCATTTTATTATTTTTTTTTTCGAGACACTCTGTCACCCAGGCT
GGAGTGCAATGGTGCAATCTCGGCTCACTGCGACCTCTGCCTCCCAGGTTCAAGCAGTTCTCCTGCCTCA
GCCTCCTGAGTAGCTGGCATTATAGGTGCCCACCACCATGCCTGGCTGATTTTTGTATTTTTAGTAGAGA
CGGGGTTTCGCCATGTTGGTCAGGCTGGTCTCAAACTCCTGACCTCAGGTGATTCGCCTGCCTCGGCCTT
TCAAAGTGCTGGGATTACAGACATGAGCCACTGTGCCGGCCCCCATTTTATTTTAGTTTTATTTTGAGA
CAGAGTCTCGCTCTGTCACCTAGGCTGGAGTGCAGTGGCGCAATCTCACCTCACTGCAAGCTCTGCCTCC
CGGGCTCACCCCATTCTCCTGCCTCAGCCTCCTGAGTAGCTGGGACTACAGGCGCCCGCCATCACGCCTG
GCTAATTTTTTTTTTTTGTATTTTAAGTAGAGACGGGGTTTCACCTGTTAGCCAGGATGGTCTCAATC
TCCTGACCTCGTGATCTGCCCGCCTCGGCCTCCCAAAGTGCTGGGATTACAGGCGTGAGCCACCGCGCCC
AGCCCCATTTTATTTTTTACTTTAAATGCCTGCCAAGGAGCAGCCTCAAGCCCAGAGAAGACTGAGGCTA
CGGGGAACTTCCCTTGCTGCAGGCTGTTGTAACACTTTAAGGGCCCCAGGTCTCCACTGCCAAGCAGGAC
TTGGCACATGAGCACCCACCCCACAGCACCATCAGGCAGCACCCATGGGCTCCACCAGCCCAGCTCTGTC
CCTCCCCTAGGTAAAGATCACACTGAAGTCTTCAAGTCCCCAGCAACCAAGTTGGGGGTGGTTTCCTTCC
TCTTCAGGCAGCCAGGCCCATGGCTGGAAGGCCGGGCTGGAGGCCCAGGGAATCGGTTACTGATGTGGCC
ACCCTATTCCCACATGGGGAGCACCAGGAGCCCTGGAGCCCCTTCCACCCAATCCCATCTCGCAGGAGAG
CAGGGTCTGGGCTCCTGCCTCACCGCTGGTTCAGCAGCACCCTCCCCGCCGGGTCCCACCTTGCCTTTTG
AAGAAGAGCCCGCATAATGAGTGGACGGCAGACAGCTATATTTAGTGGTGCCTCGACACTCACGAACCGC
CAGCGTGGCGCCTGGATCTTGCCCAGCTGCCAGCTCCCCCACCAGGACTGTGGTTCCTCAGTTTCTCCT
GCCAGCCCCGGCTCATCTCAGGGCAAAGCTATAGACATGGTAGATCTCATCGGGGAGGTTCTCCTGCCTC
TCCTCGGCCAGGAGGCTGAGGCCTGCACTGCAGATGATCCTGCGGACCACGTCAAGGTCCGGCACACGC
TGCTGTCCACGTCGTCCAGAATCACGCCCTCCTGGGCCATGTTGTCTTTGATGACGATGATGCCGTTGGG
GCGGAGGCTGCCCTTGCAGCGCCGCAGGAACTCGGCCAGGTGCTGATCGGTGAGGTGGCCTGGGGAGGGC
AGAGGCAAGGTTACCAGGGCACCATGCAAGCGGATGTCGGCACTGGATGGGATGTACTTCTCAGCCCCGC
TGAGCCCCTCATTTGTGCCCAGCATTTTGTGTGCACACATGGCCTCATTGGCTCTCAGTCCCGAGAGATT
TACTAAACCCCAATTCATAGAATAGGAAACTGTGGCTCAGAGGTCATCTACCTAAAGACACATTAAGCCA
GAATTTGACTTGACGGGATGGCTTACAAGTCCTGCCTGATACCTACACACCATGATGCCCCACCCCTGCC
AGGCTTGGATCGGAGGAGTGAACCTGGGCTAAGAGTTTGGCATTGCAGGAGCTCCCAGAGAGACTGCCTT
CCCTACACTAGAAGTCCCCACAAAGGCTTCTGAGACCACAAAATACAAGGCCAGACCTAGAGTGTCCACA
GCAGGCCTGTGCTGCCCGCCTCAGGAGGTGGCCGACTGCTGCTAGCGGCCTGCCGCCACGTCAGCAGCCC
AGGGCACAGCGCTCGAGGTGTGCTGTTAGGCTAAGAGGGTGCAGGGCTAGACACGAAGCTTAAACTATTC
ATCTTATTAAAAATAAAACCCTTATAAAACTCCAAAAAAAAAAAAAAAAAAAAAAAAAAAAAAAAAAAA
```

Figure 20 (Continued)

>gi|222144291|ref|NM_178126.3| Homo sapiens family with sequence similarity 134, member C (FAM134C), transcript variant 1, mRNA
TGTGGTGCGAAGCCACCTCCCCCGCCGAATCGCGCATCTGCGCAGTTGCTGTTATTGTGACTTGTCGGGC
CACGGCCCCGGATGTTGTGGCTGCCGCGGGGAGATGGCTGAGGCCGAAGGGGTTCCCACGACCCCAGGCC
CGGCTTCGGGGTCGACTTTCAGGGGCCGCCGAGATGTGTCAGGCTCCTGGGAGCGGGACCAGCAGGTTGA
GGCGGCGCAGCGGGCCCTGGTGGAGGTGCTGGGGCCTTACGAGCCTCTGCTGAGTCGGGTGCAGGCAGCC
CTGGTGTGGGAGCGGCCAGCTAGGAGCGCTCTGTGGTGCCTGGGGCTGAACGCGGCTTTCTGGTTTTTTG
CCCTGACATCTCTTCGTCTTGTGTTTTTACTTGCATTTGGCTTGATGATCATTGTGTGTATTGATCAATG
GAAGAACAAAATCTGGCCTGAAATAAAAGTGCCAAGACCCGACGCATTAGACAATGAGAGCTGGGGCTTT
GTGCACCCTCGGTTGCTCAGCGTGCCCGAGCTCTGCCACCATGTAGCTGAAGTCTGGGTTAGTGGGACCA
TTTTCATAAGGAATGTTTTGCTTTTCAAAAAGCAAAACCCAGGCAAGTTCTGCTTGCTGAGCTGTGGGAT
ACTGACCTTTTTGGCTGTCTTGGGCCGCTACGTCCCTGGGCTTCTGCTGTCCTACTTGATGCTTGTCACT
GTCATGATGTGGCCCCTTGCTGTGTACCACCGACTGTGGGATCGAGCATATGTGCGGCTGAAGCCAGCTC
TGCAGCGGCTAGACTTCAGTGTCCGTGGCTACATGATGTCCAAGCAGAGAGAGAGACAATTACGCCGCAG
AGCTCTCCACCCAGAACGAGCCATGGACAACCACAGTGACAGCGAAGAGGAGCTTGCTGCCTTCTGTCCT
CAGCTGGACGATTCTACTGTTGCCAGGGAATTGGCCATCACAGACTCTGAGCACTCAGACGCTGAAGTCT
CCTGTACAGACAATGGCACATTCAATCTTTCAAGGGGCCAAACACCTCTAACGGAAGGCTCTGAAGACCT
AGATGGTCACAGTGATCCAGAGGAATCCTTTGCCAGAGACCTTCCAGACTTCCCTTCCATTAATATGGAT
CCTGCTGGCCTGGATGATGAGGACGACACTAGCATTGGCATGCCCAGCTTGATGTACCGTTCTCCGCCAG
GGGCTGAGGAGCCCCAGGCCCCACCTGCCAGCCGGGACGAGGCTGCGCTGCCGGAGCTCCTGCTTGGTGC
TCTTCCTGTAGGATCCAACCTCACCAGCAACCTTGCCAGCCTGGTCTCCCAGGGTATGATTCAGCTGGCC
TTGTCAGGGGCCTCCCAACCAGGCCCTTCTGGAGCACCTGCCCAGAGAGCAACGAGAGGCTTCCTCCGGT
CCCCCAGTTCAGACCTGGACACTGATGCTGAGGGGGATGACTTTGAACTTCTGGACCAGTCGGAGCTGAG
TCAGCTGGACCCTGCCAGTTCTAGGAGCCACTGAGGCAGAGACTCCTTTTGGGAGTCACTGTGGTTTAGG
TTTTTTTCTCCCCATCCCACTTAAGGTGATGGGGCAAGGGAAGAACTCAGCTCCCCTCCCCTGAATTATA
TTTGTATGCTGGGTGGCCTGGCTGATGCTCAGAGGCCTCCTTAGAGAGGACACTCACTCCCCTCCCACCA
GCTGGATGCCCATTTCTGAGCTCAGTCACTGAAGTGAGAGTGTGCTCCCCCAAGGGAGGCTTCTCTCCAT
CAGGATGGTACTTTGGGGGAACAAAATAGTCAGGGATATTGGTTCCCCTTTGAGGAGGTGCTGCTGTTTG
CTTTTAGGTATGAGTGCTCAGGGGCCCTCACTGAAAGAGCCCATGCCTGCCTTCCTCCTTTCATCGCCTC
TCTAGAGCCCCCAAAGTCAGGCAGCAGCTGGAGTAGTTACATTGTCATCATCTTTTTTTTGAGACAGTT
TCGCTCTGTTGCCCAGGCTGGAGTGCAGTGGTGTGATCTTGGCTTTCTGCAACGTCTGCCTTCCAGGTTG
AAGAGGTTCTCCTGCCTCAGCCTCCTTAGTAGTGGGATTACAGGTGCCCGCTACTATGCCCGGCTAATTT
TTCTTTTGGTATTTTTAGTAGAAATGGGGTTTCACCATGTTGGCCAGGCTGGTCTCAAACTCCTGACCTC
AAGTGAGCTGACTGCCTTGGCCTCCCAGAGTGCTGGGATTAGTCGTCATCTTTTGTTAAACCAGGATTTG
ATTTTTTTCTTTTCTTTTCTTTTCTTTTCTTTTTTTTTTTTGAGACAGAGTCTCTCTCTGTTGCCCA
GGCTGGAGTGCAGTGGCACAATCTCGGCTCACTGCAGCCTCCGCCTGCCGGGTCAAGCGATTCTCCTACC
TCAGCCTCCTCAGTAGCTGAGATTACAGGCATGCACCACCATGCCCGGCTAATTTTTTGTGTTTTTAGT
AGAGATGGGGTTTCACCGTGCTGGCCAGGCTGGTCTAGAACTCCTGACTGCAAATGATCAGCCCGCCTCA
GCCACCCAAAGTGTTGGGATTACAGGTGTGAGCCACTGTGCCCAGCGTGATTTTTTTTTTTTTAAAGC
AAACTTGTCCTTTGGTTTTGCAGAACAGGCCTGCTCCCTCTCATCTAGCCCATCATTTCTTGGGGCCTGA
ACCCCAGTGGTCCAAAGTATTGCTTGTGAAATTTAAAAAATGTGAATATGATGTGGGGATGGGCCTCTTC

Figure 20 (Continued)

```
TACATTACCTTGGCCCAGGGGGATCAGCTGGCTGGGAGGATTAGTGAGCACCTCTGTATTTTGAGGTCTG
AGTCTTCTGGAGCTGTGTAGTTAATCTTCGGTTTCTGATAACCCCTGGGTCCATCTGGCCATCAGCCTCA
GCAGTGAGCAAAGCAATACCATACTCATTTCTATGTTCCTGTTCCTTCCTCTGCTCCTCCTTTGGAGAAG
CAATAATTCATGGGGGATGATACAGTAGCACTTTACAAATGGCTCCATGTCATTCATCCCAGGGGCCATA
ATCTCTTGCACCACCTATTCTTACTTCCTGTTCAGCTCCTTTACAGCTTTTATTTTCAACTGCTTCCCAA
CTTGGTGGGGCCTCCTTTAAGGATGAGCCAATAGTAAGAATGTGGCTGTAATCAGCAGAGACCCCTCTGA
GGGGTATCTGTTCTGCAGCCCCTAGTGAAATCATGTGATGTGAGACAGAAACCTAAACATGGTACTTGAT
TCTAAACCTGTGCCAGTCTATAGCCTCTGCCTCCCCAAGCAGAGCTCAAGCCAAACGCTTCTGTCCTCTT
TCCTTCTGCATTAACCCTTTGCTGATCCTCAGGGGCCACTCCCCCAACACCCCTGTACTTGGGTGAGGGA
TGTTGGACAGAGCCTGTTTTCATGTACTGCAGGTGGGGGTGTGCTGACATGTTTGCTCTTGGTTGATGGA
GAAGGTACAGAGGCCAGGGAGTGAAAATGGTTGACAGAAGAGGGAAGAGTTAGGTGTCTCATAGTCACTC
ATAGTGGGGTGGTCAGGGTAATGGCATCTCCCCACTTTAGGCTTCTCAAACAGACTTTTGACACCTCTC
AAGTTCAGAGCTCTGATGTGGAAAGACAGGAGGTGTGGGGAAGGAGGGGGATTTCGTGTGTTTGCATGAG
TGTGCGCTTCAGGCCTTGGGAGTTGGCAAGAGGGAGGGAAGGAAGGAGAGCAAAATCTTCGGAAGGTGTT
TCTTGTACCTGAGGGATCCTGCCCTGAATCTCCATAGTCTCCACTGTGAACTGAGGAGGGGAGGGGTGTG
CTGGGGAATAAATCTTGTATGAGAACAATCTTTAAAAA

>gi|89886463|ref|NM_178536.3| Homo sapiens lipocalin 12 (LCN12), mRNA
GCAGCTGCCAGGATGAGGCTGCTGTGTGGCCTGTGGCTGTGGCTCTCCTTGCTGAAAGTCCTGCAGGCCC
AGACCCCAACCCCCCTGCCACTCCCGCCCCCGATGCAGAGCTTCCAAGGAAACCAGTTCCAGGGGAATG
GTTCGTCCTGGGCCTGGCGGGCAACAGCTTCAGGCCGGAGCACAGGGCGCTGCTGAACGCTTTCACCGCA
ACTTTTGAGCTAAGTGATGATGGCCGCTTTGAGGTGTGGAATGCGATGACTCGAGGCCAGCACTGTGACA
CATGGTCTTATGTGCTGATACCGGCAGCCCAGCCTGGGCAGTTCACTGTGGACCACGGTGTGGAGCCCGG
GGCGGACAGAGAGGAGACCCGGGTGGTGGACAGCGACTACACCCAGTTCGCCCTGATGCTGTCCCGCAGA
CACACGAGCAGGCTGGCCGTCCTCAGGATCAGCCTGCTGGGCAGGAGCTGGTTGCTGCCTCCCGGGACGC
TGGACCAGTTCATCTGCCTGGGCAGAGCTCAGGGCCTCTCGGATGACAACATCGTCTTCCCAGATGTGAC
TGGCTGGTCACCCCAGGCCAGCGTCTGTTGAAGGATGAAGCAGCTCCTGTCCGGCCCAGCCCTGCCTCAC
AGCTGTGCGAGCTCTGCCCTCCTCAGCTCTCAAACCTGAATAAATGCACCAAGCCCAGAAAAAA >gi|269914182|ref|NM_178859.3| Homo sapiens organic solute transporter beta
(OSTBETA), mRNA
CCTGGGCGTGTGCTAAGGCCAGAGCTACCAGATGGGTCCAGCTGCCGCAGGCTCTCCAGGCACTGTCCCC
TAAGTGACAGCTGTTACTGCCTGGGAGAGCTCAAGTGCAAAGACTATCCTGTTCTCCCATAAAGAGGAGG
AAAAGGAAGATACAGAAATCGGTGCTGCTCCCAACAGCAGATCAAGGCAGTCGTCAGGAACTCAGGATCC
GGGGGGTCTTCACGGCTTCTCTGCCCAGGGGCCAGAACCGAGGAGGCCAGGAGGGCTGCTGGGGCTAAGG
GGTCTAAGGACCTCGTTGCACACGCTACCAGGAGCAGGGCATGGAGCACAGTGAGGGGCTCCCGGAGA
CCCAGCCGGTACTGTGGTACCCCAGGAGCTGCTGGAAGAGATGCTTTGGTTTTTTCGTGTGGAAGATGCA
TCTCCCTGGAATCATTCCATCCTTGCCCTGGCAGCTGTGGTGGTCATTATAAGCATGGTCCTCCTGGGAA
GAAGCATCCAGGCAAGCAGAAAAGAAAAGATGCAGCCACCAGAAAAAGAAACTCCAGAAGTCCTGCATTT
GGATGAGGCCAAGGATCACAACAGCCTAAACAACCTAAGAGAAACTTTGCTCTCAGAAAAGCCAAACTTG
GCCCAGGTGGAACTTGAGTTAAAAGAGAGAGATGTGCTGTCAGTTTTCCTTCCGGATGTACCAGAAACTG
AGAGCTAGTGAGGGTTCAGAGAAGCCCCATCCTAAGCCAGACACATGATGTGGGCTCAGCTCAGTGGCCT
```

Figure 20 (Continued)

```
GAAACCTCTCAGGTTTTAGAGTCTCTCCCAAGAAGCCGCTTTTTCTTTTTCTTTCTTTCTTTTTTTTT
TCTTAGCAGATACAATGAATGAACTGCAAGCAAACTAAAATTCTGTTATTAAAAAAAATCTTTTATTAAA
ATGCTCCTGGAAGGGAGCAGGTGGTATTGC

>gi|315434202|ref|NM_181349.2| Homo sapiens SMAD specific E3 ubiquitin protein
ligase 1 (SMURF1), transcript variant 2, mRNA
GCGCGGCTCGGAGAGGCGGCGGCAGCGGCGGAAGCGGCGAGGGCGGCGGGCGTCCGGCTCTGAGGTGGTG
GAGGCGGCGGAGGCGGCGGCGGAGGCGGCGGCGGCTCGGGACTGGGCTCGGCTGGAAGCAGCGAGGGTCA
GAGCGCCGCAGCAAGCGCCGATCTCCCGGCTCGACCATCCGCCTGCCGCCCGGACGCCTGGGCCGCGGAG
TTTGTGTCCCGGCTCGGACCCCGGCGCCCAGCCCGGAGCCGTAACCTTGAGGCGGCGGCGGCGGGCCGG
GCCGGGCCGGGCTGGGGGGCGGTGGCGCTGGATCCGCGGCTGCCCGATCGTTGGCGGGAGATGTCGAACC
CCGGGACACGCAGGAACGGCTCCAGCATCAAGATCCGTCTGACAGTGTTATGTGCCAAGAACCTTGCAAA
GAAAGACTTCTTCAGGCTCCCTGACCCTTTTGCAAAGATTGTCGTGGATGGGTCTGGGCAGTGCCACTCA
ACCGACACTGTGAAAAACACATTGGACCCAAAGTGGAACCAGCACTATGATCTATATGTTGGGAAAACGG
ATTCGATAACCATTAGCGTGTGGAACCATAAGAAAATTCACAAGAAACAGGGAGCTGGCTTCCTGGGCTG
TGTGCGGCTGCTCTCCAATGCCATCAGCAGATTAAAAGATACCGGATACCAGCGTTTGGATCTATGCAAA
CTAAACCCCTCAGATACTGATGCAGTTCGTGGCCAGATAGTGGTCAGTTTACAGACACGAGACAGAATAG
GAACCGGCGGCTCGGTGGTGGACTGCAGAGGACTGTTAGAAAATGAAGGAACGGTGTATGAAGACTCCGG
GCCTGGGAGGCCGCTCAGCTGCTTCATGGAGGAACCAGCCCCTTACACAGATAGCACCGGTGCTGCTGCT
GGAGGAGGGAATTGCAGGTTCGTGGAGTCCCCAAGTCAAGATCAAAGACTTCAGGCACAGCGGCTTCGAA
ACCCTGATGTGCGAGGTTCACTACAGACGCCCAGAACCGACCACACGGCCACCAGTCCCCGGAACTGCC
CGAAGGCTACGAACAAAGAACAACAGTCCAGGGCCAAGTTTACTTTTTGCATACACAGACTGGAGTTAGC
ACGTGGCACGACCCCAGGATACCAAGAGACCTTAACAGTGTGAACTGTGATGAACTTGGACCACTGCCGC
CAGGCTGGGAAGTCAGAAGTACAGTTTCTGGGAGGATATATTTTGTAGATCATAATAACCGAACAACCCA
GTTTACAGACCCAAGGTTACACCACATCATGAATCACCAGTGCCAACTCAAGGAGCCCAGCCAGCCGCTG
CCACTGCCCAGTGAGGGCTCTCTGGAGGACGAGGAGCTTCCTGCCCAGAGATACGAAAGAGATCTAGTCC
AGAAGCTGAAAGTCCTCAGACACGAACTGTCGCTTCAGCAGCCCCAAGCTGGTCATTGCCGCATCGAAGT
GTCCAGAGAAGAAATCTTTGAGGAGTCTTACCGCCAGATAATGAAGATGCGACCGAAAGACTTGAAAAAA
CGGCTGATGGTGAAATTCCGTGGGGAAGAAGGTTTGGATTACGGTGGTGTGGCCAGGGAGTGGCTTTACT
TGCTGTGCCATGAAATGCTGAATCCTTATTACGGGCTCTTCCAGTATTCTACGGACAATATTTACATGTT
GCAAATAAATCCGGATTCTTCAATCAACCCCGACCACTTGTCTTATTTCCACTTTGTGGGCGGATCATG
GGGCTGGCTGTGTTCCATGGACACTACATCAACGGGGGCTTCACAGTGCCCTTCTACAAGCAGCTGCTGG
GGAAGCCCATCCAGCTCTCAGATCTGGAATCTGTGGACCCAGAGCTGCATAAGAGCTTGGTGTGGATCCT
AGAGAACGACATCACGCCTGTACTGGACCACACCTTCTGCGTGGAACACAACGCCTTCGGGCGGATCCTG
CAGCATGAACTGAAACCCAATGGCAGAAATGTGCCAGTCACAGAGGAGAATAAGAAAGAATACGTCCGGT
TGTATGTAAACTGGAGGTTTATGAGAGGAATCGAAGCCCAGTTCTTAGCTCTGCAGAAGGGGTTCAATGA
GCTCATCCCTCAACATCTGCTGAAGCCTTTTGACCAGAAGGAACTGGAGCTGATCATAGGCGGCCTGGAT
AAAATAGACTTGAACGACTGGAAGTCGAACACGCGGCTGAAGCACTGTGTGGCCGACAGCAACATCGTGC
GGTGGTTCTGGCAAGCGGTGGAGACGTTCGATGAAGAAAGGAGGGCCAGGCTCCTGCAGTTTGTGACTGG
GTCCACGCGAGTCCCGCTCCAAGGCTTCAAGGCTTTGCAAGGTTCTACAGGCGCGGCAGGGCCCCGGCTG
TTCACCATCCACCTGATAGACGCGAACACAGACAACCTTCCGAAGGCCCATACCTGCTTTAACCGGATCG
ACATTCCACCATATGAGTCCTATGAGAAGCTCTACGAGAAGCTGCTGACAGCCGTGGAGGAGACCTGCGG
```

Figure 20 (Continued)

```
GTTTGCTGTGGAGTGAAAAGCAACCAAAGGCAACAGAGTCTAGCTCATGGCCACCAGACCAAAAGCATCC
AGCTTCTGTGCACCTCCTGCAAAGCTGGCAGAGGCCCTGGAATTCCAGATCACCTGAGGGGAAAGGGTTG
TCTCTCTCCTTTCTGTTGGGGGAGGGGGATGGGGGACTTTTGTTGGTGGCTCCCACCCATATATCCCTCC
TTTACCATAGTACTCCCACCCACTTCCATCACCCATCCAATAAAATGCAGCCAGGTTTAGCCTTTGGCTT
TGGTCACACAGGATATTCTGCTGTGTTGCAACCCATGTGGTGATAAGGCTCACAGCCCTGAGCTCTTTAC
GGGAGCATCAACTCACAGTTAGGGGACTGGGCGTGGCTGATTGAGGGTTTGGAACTGGTGGCTATGCCAG
CTATTCCATCTCAAAACAGCCTTGAGGCCCCTTTTCAATTTGAGCAGCTGCTAGATATCTTATCAGAGCT
CAGATTCCAGATTTCACATCCCAGCAGCCGGTTCTGGGTAGCAGATCAATTTCCAACTGGAAAATAACTA
TATAATGTATGCTTATTGGAATTCTGCCACAGCAGGAAGCTTGAGTCAAAATGTGTTTCCCCTTTGAAAG
GAGAAGGAATTGGAGCAGCTTTTCCTGGAGGCCCAGGATATTTCTTTTCTGGGTATCTTGGCTGAAAATT
TTGTTTTACATAGAGAAAAACGATCTTTTAAGGGTCCCTTTTGCTGCATTATCTGTCCAGTTTGACTTTT
TTTTCAGTGAAAACACCATGTCATGGAGTGTAGGAAAGAGCAGACCAAAATCAGCCCTAGAGCCAACCAG
TCAGTCCCAAAGCTGTGACCTCTGTGCCACTGTTGTCCATAGAAGAGCATCGACTGTGTCACTTAAAATA
TTAGTAAACCATGATGCAGCAACTGCTAAGAGCTAAACTAACAAAATTGTGTCATCATAGCTGCTGGCTT
GGTGTGAACTCGCTTAAAAGCAATGGTGAAAGGATAACCTCGATGATGTAAATCCACCCAAAGATACTGT
TCTACAAAAAGTAGGGTGTGGACGCAAACCTGTGACAGCAGAGGGGACGACTTCACACTCACTGCCTCA
TGTGGCCCCTTTCCCAGTGGCAGCTGGTGACACTAACGATTGCTACTCGGTTCACTTGCCCAGATGTCTT
CATATGATGAGCAAGGCCAGAAGCAAGGCTAGATTCGAAGTTTCTGACACCATTTCCAGTTTGCACAAAA
GTCAGTATTTTATCTTAAAGTGGCTTGATTTCCAATAGCTGAACTTGGGCAGAAAACAGCAGGCCAATGT
TCCTATGTGGTTTCTTTGTTGTTGTTTTGTTTGGGGTGGGGCAAGTACAGGGTAATTCATGAGCAAGA
CATTTCACTGCTGTCGAAGTCTCTGGGATCCCGCTGTGGGTCTGAGATGGCCTGGGAAGGACCTTGTGGA
CAATGGTTTTATCTGTTCTTTTTGTCACTGTTAATTTCTGGGCTGCTGAGGTTCTAGAATAGAAGGGCTG
CCAAATGAGGTTTGCTGCAGGAGGAAAGTTTAATCCCCCATTCCAAAAGTCCAGGCCAAATGGTGGGCTT
AGCCTCTTTGAAAAGTTCTGCCTTGCCCCCACAGGTGGGCACATCCTGTGTCTCATTCACCATGATGCTT
CCTGAGGGTGTTCTAGAAGCCCGTTCCCCAGTGGCTGTATCCAGCCTTTCCTTGCATCATCTTCCTCTTG
AAGGTGAGGAAGTGAAAACTACAGACCTCCCCCGGACAGCCCACTCTCTATCACGAGCCTAACCCGCGGG
AGGCGGAAGAGACATCCATTCGAGAACTGAAGCGGCCTCCGGGATGAGGTCAGAGGCCCCACCTGATTTT
CCTGGTGGTGGTATCCAAAATCTTCAGTAACTAGGAAGGAAACCAGGGTCTCATGGTTTAAAAGACTTTG
AAGCAGGAATGTTGCATTTGACGCCTTTAAAACTACCTTTTTGCTGTTGGGAGGAGTCGGGGGCGAGCCT
TAGCAGCTGCACCGCCATCCCCATGCTGGTTGGTGCTGCCCTGCCTCTCGTGCCGGGTGTTGCTTCAGCC
CAGAGCCAGAGGGCTGGGTCCCGGGTCCTCCACAGGTGACCCCGGTGGACACACGCGTTCCCATCCTGGC
CTCCGTCTCTGCTTTTCCACTTCTACCTGCGTGTGGGTTTGCCGCCTTGTCATCGGTTGTGTGAGTGTCG
CAGACCTTTCCAGAGCTCCGGTTCACTCTTTCCAAACAGGCCTCCCTGTCGGTGGCACTGCACTCCTAGA
ACCTTCAGTTTCTACGATGGTTTGTTTGGTCCTTTTGAACCACCCCAAAGAACTCAACATGGCAAAGCAA
ATGGTAAAAGCTTCCCGACTGTTCTACTTTGGGTCCGCGCGAAGCCCACTCACGTGTGATCTGTGTTGCC
CCTCTCGGTGGTCCCAGGCGATCCAGCCATGCCCCCTGCCCCTCTGCCCAGATGCTTCAGGGGCCCGGCT
TTTCAGGCTTGCCCTCACCAGCGGCCGTCAGCCGACACTCAGGGATGTAGCTAACACCACTCCGCCAGTG
CTTTCAGTAGGAAGAGCTGAGGCTGCCTGGGAGGCCCGGGGCGACCGGAAAAGGGCTCTCTCAAGTTCTG
AAAAGAGAATCTGCCACCAGATCGAATTTCGACCCCTGAGCTTGTTCGGACGTATGGTCCAAATTCAGAT
TAAGGTGGTCACCCAACCCGAGATGTCAGGAAAGGCCTTCTGCAGAGAAATGTCCCCCCACCCGCCATC
TGCAGCCAGGTGTGTGCCACACGGCAGCCTTCCCGAAACATAGTATGGATTTTAAAAATGTGTTTATTTT
TGTTTCTCAACCACTTTATAACGTATTTTTAATTTATTTTGTAATGTCTTGTTTTGAAGTATTGCTGCT
```

Figure 20 (Continued)

ATCCTTGTTATCCTTCCCACTGTTTTTATCACTGATTTATTTTGTGAAAGTTGTACACTAATGTTCTATG
TCAAAATCAAAAGTATTTAATGAAATACTAGTTCTATTTAATGTGGTTATGGAACCAGCTGGAAACACAA
AACAAACAGTGATTGTACAGCAGGCTGGGCCCAGGAGGTCAGGTTCATTTTGTTACATATGCAATAAACT
CACGACTTTACATTTAAAAAAAAAAAAAAAAAA

>gi|32307135|ref|NM_181689.1| Homo sapiens neuronatin (NNAT), transcript variant 2, mRNA
TAGGTGGCGGGCGGGTACTTAAGGCGCGGCCACCGCGGCTGCGGCAGTGCGCCCAACAGCGGACTCCGAG
ACCAGCGGATCTCGGCAAACCCTCTTTCTCGACCACCCACCTACCATTCTTGGAACCATGGCGGCAGTGG
CGGCGGCCTCGGCTGAACTGCTCATCATCGGCTGGTACATCTTCCGCGTGCTGCTGCAGGTGTTCAGGTA
CTCCCTGCAGAAGCTGGCATACACGGTGTCGCGGACCGGGCGGCAGGTGTTGGGGGAGCGCAGGCAGCGA
GCCCCCAACTGAGGCCCCAGCTCCCAGCCCTGGGCGGCCGTATCATCAGGTGCTCCTGTGCATCTCGGCC
AGCACGGGAGCCAGTGCCGCGCAGGAATGTGGGGTCCCCTGTGTTCCCTCGCCAGAGGAGCACTTGGCAA
GGTCAGTGAGGGGCCAGTAGACCCCCGGAGAAGCAGTACCGACAATGACGAAGATACCAGATCCCTTCCC
AACCCCTTTGCACCGGTCCCACTAAGGGGCAGGGTCGAGAGAGGAGGGGGGATAGGGGGAGCAGACCCCT
GAGATCTGGGCATAGGCACCGCATTCTGATCTGGACAAAGTCGGGACAGCACCATCCCAGCCCCGAAGCC
AGGGCCATGCCAGCAGGCCCCACCATGGAAATCAAAACACCGCACCAGCCAGCAGAATGGACATTCTGAC
ATCGCCAGCCGACGCCCTGAATCTTGGTGCAGCACCAACCGCGTGCCTGTGTGGCGGGACTGGAGGGCAC
AGTTGAGGAAGGAGGGTGGTTAAGAAATACAGTGGGGCCCTCTCGCTGTCCCTTGCCCAGGGCACTTGCA
TTCCAGCCTCGCTGCATTTGCTCTCTCGATTCCCCTTTCCTCCTCACTGCCTCCCAAGCCCACCCTACTC
CAAAATAATGTGTCACTTGATTTGGAACTATTCAAGCAGTAAAAGTAAATGAATCCCACCTTTACTAAAA
CACTTTCTCTGAACCCCCCTTGCCCCTCACTGATCTTGCTTTTCCCTGGTCTCATGCAGTTGTGGTCAAT
ATTGTGGTAATCGCTAATTGTACTGATTGTTTAAGTGTGCATTAGTTGTGTCTCCCCAGCTAGATTGTAA
GCTCCTGGAGGACAGGGACCACCTCTACAAAAAATAAAAAAAGTACCTCCCCTGTCTCGCACAGTGTCCC
AGGACCCTGCGGTGCAGTAGAGGCGCACCAAAAAAAAAAAAAAAAAAAAAAAAAAAAAAAAAAAAAAAA >gi|116014338|ref|NM_182487.2| Homo sapiens olfactomedin-like 2A (OLFML2A), mRNA
GCAGGCGCGGGGCGCGGGGCAGGCAGAGCGGGCGAAGGCGCGGAGCTCGCAGTGCAGCCCGCGCTTCCCA
GCGTCCGTGCCCGGCCGCCTGTGCCTACCGTGCCCGTGGCGCCATGGCCGCTGCCGCCCTCCCGCCCCGG
CCGCTGCTCCTTCTGCCGCTAGTGCTGCTGCTGAGCGGCCGCCCCACGCGCGCCGACAGTAAGGTGTTTG
GGGACCTGGACCAGGTGAGGATGACCTCGGAGGGCTCCGACTGCCGTTGCAAGTGCATCATGCGGCCCCT
GAGCAAGGACGCGTGTAGCCGAGTGCGCAGTGGGCGGGCACGCGTGGAGGACTTCTACACGGTGGAGACT
GTGAGCTCGGGCACTGACTGCCGCTGCTCCTGTACCGCACCTCCCTCCTCTCTCAACCCCTGTGAGAACG
AGTGGAAGATGGAGAAACTCAAAAAGCAGGCGCCCGAGCTCCTCAAGCTGCAGTCCATGGTGGATCTCCT
GGAGGGCACCCTGTACAGCATGGACTTGATGAAGGTGCACGCCTACGTCCACAAGGTGGCCTCCCAGATG
AACACACTGGAAGAGAGCATCAAGGCCAACCTGAGCCGGGAGAATGAGGTGGTGAAGGACAGCGTGCGCC
ACCTCAGTGAGCAGTTGAGGCACTATGAGAATCACTCTGCCATCATGCTGGGCATCAAGAAGGAGCTGTC
CCGCCTGGGCCTCCAGCTGCTGCAGAAGGATGCCGCCGCCGCCCTGCCACCCCTGCCACGGGCACTGGT
AGCAAGGCCCAGGACACAGCTAGAGGAAAAGGCAAGGACATCAGCAAGTATGGCAGTGTGCAGAAAAGCT
TTGCAGACAGAGGCCTCCCAAAACCTCCCAAGGAGAAGCTGCTTCAGGTGGAGAAGCTGAGAAAGGAGAG
CGGCAAGGGCAGTTTCCTCCAGCCCACAGCCAAGCCCCGCGCCCTGGCCCAGCAGCAGGCTGTGATCCGG
GGCTTCACCTACTACAAGGCAGGCAAGCAGGAGGTGACCGAGGCGGTGGCAGACAACACCCTCCAGGGCA Figure 20 (Continued)

```
CTTCCTGGCTGGAGCAACTGCCGCCCAAGGTGGAGGGCAGGTCCAACTCCGCAGAGCCCAACTCCGCAGA
GCAGGATGAGGCTGAGCCCAGGTCCTCCGAGCGAGTGGACCTGGCTTCTGGCACCCCCACTTCAATCCCT
GCCACCACCACCACCGCCACCACCACCCCAACCCCCACCACCAGTCTCCTGCCCACCGAGCCACCTTCAG
GTCCAGAAGTCTCCAGCCAAGGCAGAGAGGCGAGCTGTGAGGGCACCCTCCGGGCTGTGGACCCCCCTGT
GAGGCACCACAGCTATGGCGCCACGAGGGAGCCTGGATGAAGGACCCTGCAGCTCGAGACGACAGGATC
TATGTCACCAACTACTACTATGGAAACAGCCTGGTGGAGTTCCGCAACCTGGAAAACTTCAAGCAAGGCC
GCTGGAGTAACATGTACAAGCTACCCTACAACTGGATCGGCACAGGCCACGTGGTGTACCAGGGCGCCTT
CTACTACAACCGCGCCTTCACCAAGAACATCATCAAGTACGACCTACGGCAGCGCTTCGTGGCCTCCTGG
GCGCTGCTGCCCGACGTGGTATATGAGGACACCACACCTTGGAAGTGGCGCGGACACTCGGACATTGACT
TTGCCGTGGACGAGAGCGGCCTGTGGGTCATCTACCCCGCCGTGGACGACCGCGATGAGGCCCAGCCCGA
GGTGATCGTCCTGAGTCGCTTGGACCCCGGCGATCTCTCCGTGCACCGGGAGACCACGTGGAAGACACGG
CTGCGGCGGAACTCCTACGGGAACTGCTTCCTGGTGTGCGGCATCCTGTATGCCGTGGACACGTACAACC
AGCAGGAAGGCCAGGTCGCCTACGCTTTCGACACGCACACGGGCACCGACGCACGCCCCCAGCTGCCGTT
CCTCAACGAGCACGCCTACACCACCCAGATCGACTACAACCCCAAGGAGCGGGTGCTGTACGCCTGGGAC
AATGGCCACCAGCTCACCTACACCCTCCACTTCGTGGTCTGAGTGGAGACCTGTGCTCCCCGGAGAGGGG
CAGCAGTGCGGGAGGGCTTTGCACAGCAGCTCCTGCAACTGACCCAGTCCGCAAATATTTATTGGGGGC
CAGCCCAGGGCTGGGACTGGGCATGAGGTGGTCACCAGGATTGAGCTTCCTCAGCACCCAGTGGGTAATA
CTTGCTTCCACTTGCAGAGCACCGTGCCAAGCACTTCCCACACACTTACCCGTTTGATTCTCCTAGCACC
TCCCTTGGAGGTAGAGATCATGAACCCATTTAACAGACGAGGAGACAGGCTCAGAGAGGCACCGTCCCTT
GCCTAACACCTCAGTTGTGATCAGGCAGGCTGTGCTCTCAGGACAGCCCCATTTTAGGGATGAGGAGACT
TCACCACGCCCTCCCCTCCCTGCCCTCCCCCATCTCCCCGGTCTCCCTTGTTCTCTCAACCCAGTCTCCC
TTCCCAGGGCCACTCAGAACCAGAGGTCTTTAGGGCCAGTGTACTGGTGTGGGGTGGAGGCCCTGGCTCT
GCCTGCCATCCTAGGGCCCTGTTCTGGCTGAGCTGTTGGTGGCCCTGGGCTTTGGGCCCCTTAGCCAATG
TCCTTGTCTCTTGTCTTTGGCCAGCCCCCTCAGCCCAGCCCACCCCACCCGCTGTCCGGCCACATTCCAA
ACCTCTACCGTCACCTAGCTGCTGAGCAGAAACCGCACCCCGAGAGAAAATCCCATCCTCTGTTCCAAGG
CCCCTGTCTGCTCTATGCTCATTTTTATTTTCTCTTATTCTTCATCAGTGCCGTCATTTGTTTCTGCAGC
AGCAGCTGAGAAGGCAGCCGGCAGCTCTGCCAGGGTGGGGAGCTGAGCTGAGGCTCCCTCTCCACCCAGA
AGCACTGGCGTTGTTCACATAGTCAGGCCTTGGGTCCCCTCCCTGGTTCATCCCAGAGCCTTTGGGCCTG
GAGTCCGCCTTGTCCTTTTTCTCTGGGCTTTCAAACCCACAACCTTTACACACTCAGGGATACCTCCGGG
TCTGCCATGAATAAGACCCTAGGCCCAAGTCTGGTGTGGTGCCAGGATGGCACAGTTTCCCTCTTCCTTG
CCAGCCCTGACCTGGTCACTGGGCAGGCTGGCCCAGCAGCCTGGGGCTGCAGAAGACATGGTGTGAGTA
GTTGGGTCCAGGGGAGGCATCAGGCCTTCTTCTGGTTGCAGGAGAGAACCAGAGGGTGGGAACGGGGAGG
GAAGAACTGAGGGTCTGCAGACTGGACTTTTCCTGGCTCGACCCAGGACTTGGGTTGAGGATGCACGGGG
GCCACCTTGCCCGGGGCCACTGGTGGCTCCCAGAGCCTCAGACCCACACAGCCCAGAGGACGAGGCCTT
CAAGCCTGCCCCTCTTCTGCTTTTTTAGACAGTATTTTTAGAGCTGGAAAGAAATTTTCTAGCCCAACTC
CCTGTTTCATGAAAGAGAAAAGAGGCTCAGAAAAGTTTAGAGAGCAGCTCAGTGTCACACTGGGAGCTGG
GCACAGCCGATCTCCTTCCAGAAGGGTTCTGTCTGTATCCTTTATTCTCCGCACATGGAGGCTGCCCTAC
CTGGGAAGGCACCCCAGCACCTGTGAAGGACATTTACTGCTCATCCTCACCTGCCCCCTGGCCCTTGCTG
CCTTCATTCTGTCCCAATGCCAGCTCCCTGGATGTCTGTATGTTTGAATACCAGTTGCCATGTTAGGAAG
GTCAGCTGCACAGCCAAGAGTGTAAGAGTGTAAAGAAATGCCTTTTTTTTTTTTTTGAGTTGGAGTTTT
GCTCTTGTCGCCCAGGCTGGAGTGCAGTGGCGCGATCTCGGCTCACTGCAACCTCTGCCCCCTGGGTTCA
AGCGATTCTCCTGCCTCAGCCTCCCTAGTAGCTGGGACTACAGCACCCACCACCACACCCAGCTAATTTT
```

Figure 20 (Continued)

```
TGTATTTTTAGTAGAGACAGGGGTTTCACCACGTTGGCCAGGCTGGTCTCGAACTCCTGACCTTAGGTGA
TCCGCCCGCCTCAGCCTCCCAAAGTGTTGGGATTACAGGCATGAGCCACTGCGCCTGGCCAGCAAATGCT
TTTTGTGCAGAATACACTTCTTTCAGGCATTGTCAGGTGCTGTTTTGTTTAAGCTCTAACTCACCCCTGG
AATACAGGGGAATGATGACAACCAGCCCAGCCAGGCCTGACTCATCATGGTCACATCCAGCCCCCACCCC
CGGCCAACTAACCACTGCAGGCTCCTCTTCCAGACTCACCAGGGGGCCTCGAGGCCCCGGCATCTCCCTT
GGCCCTGGGTGTGGGTTTTACAAGACTGTGTCTTTCATGACATCATAGCCCAACCATGTGAGAAGAAGGA
GAAGGCCCCCCTTTCTTCATTAATCTGAAAAAAAGGAAAGTGAGAATAGGCTGATTTTTAAAAGTTAAGG
GGCAAGCAGCATTGCATTCTGGGGGAACGATCCTGGCCACAGCCGCCAAACAAACATTCACTAGGCCTCT
TCTGTTTTCATACCCTTGTAAGTGGGTTATGTGGTGGGTATGGTCAGTTTTTTCTTTTTTCTTTTCTTTT
CTTTTTTTTGAGACAGAGTTTCGCTTTTGTTGCCCGGGCTGGAATGCAATGGCGCGATTCAGCTCACTGC
AATCTCCGCCTCCCGGGTTCAAGTGATTCTCCTGCCTTAGCCTCCTGAAAAGCTGGGATTACAGGGCCCT
GCCACCAAGCCCAGCTAATTGTATTTTTAGTAGAGACAGGATTTCACCATGTTGGCCAGGCCAGTCTCAA
ACTCCTGACCTCAGGTGATCCACCTGCCTCAGCCTCCCAGACTGTTGGGATTACAGGCATGAGCCACCAC
GCCTGGCCAGTTTCTTCATTTTACATATGGTCACATTGGCGCCTAGAACAGTTAGGTCGCTCGTCACATA
GGCAGTTAAGTGGAGAACCAGGTTTCAAAATCAGGTAAGAAAACCATCATCATTAACTGAGCACCAGCTG
TGCTAAGCCTGCCACGGGCGTATCCTTGCAGCCTCACAACAGTGGGAGGTCTGTATCCTGAATGTCCTCA
TTTTACAGATGAGGACATTGAGGAGAAGAGACTTACCCAGGCTCACACAGCAGCTCAGCCTGTTCCAGGC
GCTGGTCAGTGCGTGTTCTTTGCCACCAGCCTGTCACTCCAGTGGCAGCTCCAGAAACGGAGGCTGTTGC
TTTTATCCCTAAACTGCATCCACAGAGAAGCCCCAAGAAGGAGGTTGGGGCCAGCTCATAAAAAGCCTGA
ATGCCAAGCCAAGGAGTGGATGCCTCCAGTCATATTTAGAACAAAGTCAAGTATAAATTTACAGAGAAAA
AATTCTAAGACAGTTGGATGTTGTCCTGTTGGTGAGGAAGGGAAAGGTTTTTCTTGTAGGGAACTGGAAC
CAGCCCACAACTGCACGCTTGTGAGCTGTCATGGAAACCTGATCCCCAACAGCTTTTGAGGTTGTTTGTT
TGTTTGTTTGTTTACCTGTCTTGGGCTTTGTTGCTTTTGGCAAAAGGTACTTCAAACAAGGGAGGGCCTG
GACTGAGGGGGACCAGGTCTTCTTGCTGACCTCGTCTACAAAGGCAAAGGAAGGCAAAGGAAGCTGTCTC
GGGTGTTTCTGAACAACGTGACTCATGAGGGGCTTTGGCTACCTCTTGCGTTCCCCCTAGAGATGTCCAG
GCCTTACATTTAATCGGCTTTCTCTGCGGTGGGGTAGAGAATGGAGCTCCCGCCTTGCGGGCAGTGCTAA
AGGTGGAGCTGGGGATTTTCCTGGGAATGATTTGAGGGCTCTTGAAAGCCCATGTGTTCCAAAGCGTCT
TTAACTCTGGGATAGCATTGGAAGCCGCTGTCATGACAGGACATGGCACTGGATGGCTGGCAGAGAGCCC
TGGCTGGGAGTTAGGGAGCCCTGGGTTGGAATCCAGCCCCACCTCTTTTATGCCACAGGTTTGGTCAAGT
TCTCTCCCGCTCAGGGTAGGGCTGTGAACTCCCTCTTACAGCTAAGAACATGCAGCTTAGTGAGGACAAG
ACCCTTCTAGAGCTTTACCCCTAATCCCCCCCCAGGAGCCCCGAGGCCGGCATTATTCCTCCCCATTACA
GGTGATGAGCCTCAAATTCAGAGAGCTTAAGCAACCTGCTCAGGGTCACGTCTCCAACAGGCAGTAGAGT
CAAGGTATAAACCAGGTCTGTTTTTGTACCAGAGTCCCAGACTAACTGTTGGTAGGAATCTTGTAACCAG
TCATGTTTTCTTCCTTGTTTTGGCCGCTGGGAAGCTCAAAGTCAAATTCGAGACCCTTTTTTTTCCAATT
GTGCTGAGTCTCCTACTAGACTCGCTTCATTCTAGCTTTCTGCTTTTACCTTTACCCTAATCTTTTTATT
TTTATGCTATTGTACTTTATTTTTGTAAGTTGCTGAGATATCTGTTTTGCAACAAGATGGGCTATATCTA
AATAAAGACATGATCAAAGGTTTGATTTAAAAAAAAAAAAAAAAAA
```

```
>gi|146219831|ref|NM_182493.2| Homo sapiens myosin light chain kinase 3 (MYLK3),
mRNA
AGGAGTCTGTCAGCTACGGAGGACAATGACCTTGCAGACACCACCGCCTGAGTGAGAACCAGGGGTCTGT
GCCTCTCCTCATTCCCCGCTCTTGCCCTTGTCAAGCCTGCACCAGCATGTCAGGAACCTCCAAGGAGAGT
```

Figure 20 (Continued)

```
CTGGGGCATGGGGGGCTGCCAGGGTTGGGCAAGACCTGCTTAACAACCATGGACACAAAGCTGAACATGC
TGAACGAGAAGGTGGACCAGCTCCTGCACTTCCAAGAAGATGTCACAGAGAAGTTGCAGAGCATGTGCCG
AGACATGGGCCACCTGGAGCGGGGCCTGCACAGGCTGGAGGCCTCCCGGGCACCGGGCCCGGGCGGGGCT
GATGGGGTTCCCCACATTGACACCCAGGCTGGGTGGCCCGAGGTCCTGGAGCTGGTGAGGGCCATGCAGC
AGGATGCGGCCCAGCACGGTGCCAGGCTGGAGGCCCTCTTCAGGATGGTGGCTGCGGTGGACAGGGCCAT
CGCTTTGGTGGGGGCCACGTTCCAGAAATCAAAGGTGGCGGATTTCCTCATGCAGGGGCGTGTGCCCTGG
AGGAGAGGCAGCCCAGGTGACAGCCCTGAGGAGAATAAAGAGCGAGTGGAAGAAGAGGGAGGAAAACCAA
AGCATGTGCTGAGCACCAGTGGGGTGCAGTCTGATGCCAGGGAGCCTGGGGAAGAGAGCCAGAAGGCGGA
CGTGCTGGAGGGGACAGCGGAGAGGCTGCCCCCCATCAGAGCGTCAGGGCTGGGAGCTGACCCCGCCCAG
GCAGTGGTCTCACCGGGCCAGGGAGATGGTGTTCCTGGCCCAGCCCAGGCATTCCCTGGCCACCTGCCCC
TGCCCACAAAGGTGGAAGCCAAGGCTCCTGAGACACCCAGCGAGAACCTCAGGACTGGCCTGGAATTGGC
TCCAGCACCCGGCAGGGTCAATGTGGTCTCCCCGAGCCTGGAGGTTGCACCAGGTGCAGGACAAGGAGCA
TCGTCCAGCAGGCCTGACCCTGAGCCCTTAGAGGAAGGCACGAGGCTGACTCCAGGGCCTGGCCCTCAGT
GCCCAGGGCCTCCAGGGCTGCCAGCCCAGGCCAGGGCAACCCACAGTGGTGGAGAAACACCTCCAAGGAT
CTCCATCCACATACAAGAGATGGATACTCCTGGGGAGATGCTGATGACAGGCAGGGGCAGCCTTGGACCC
ACCCTCACCACAGAGGCTCCAGCAGCTGCCCAGCCAGGCAAGCAGGGCCCACCTGGGACCGGGCGCTGCC
TCCAAGCCCCTGGGACTGAGCCCGGAGAACAGACCCCTGAAGGAGCCAGAGAGCTCTCCCCGCTGCAGGA
GAGCAGCAGCCCCGGGGGAGTGAAGGCAGAGGAGGAGCAAAGGGCTGGGGCCGAGCCTGGCACGAGACCA
AGCTTGGCCAGGAGTGACGACAATGACCACGAGGTTGGGGCCCTGGGCCTGCAGCAGGGCAAAAGCCCAG
GGGCGGGAAACCCTGAGCCTGAGCAGGACTGTGCAGCCAGGGCTCCGGTGAGAGCTGAAGCAGTAAGGAG
GATGCCCCAGGCGCCGAGGCTGGCAGCGTGGTTCTGGATGACAGTCCGGCCCCACCAGCTCCTTTTGAA
CACCGGGTAGTGAGCGTCAAGGAGACCTCCATCTCTGCGGGTTACGAGGTGTGCCAGCACGAAGTCTTGG
GAGGGGGTCGGTTTGGCCAGGTCCACAGGTGCACAGAGAAGTCCACAGGCCTCCCACTGGCTGCCAAGAT
CATCAAAGTGAAGAGCGCCAAGGACCGGGAGGACGTGAAGAACGAGATCAACATCATGAACCAGCTCAGC
CACGTGAACCTGATCCAGCTCTATGACGCCTTCGAGAGCAAGCACAGCTGCACCCTTGTCATGGAGTACG
TGGACGGGGGTGAGCTCTTCGACCGGATCACAGATGAGAAGTACCACCTGACTGAGCTGGATGTGGTCCT
GTTCACCAGGCAGATCTGTGAGGGTGTGCATTACCTGCACCAGCACTACATCCTGCACCTGGACCTCAAG
CCCGAGAACATATTGTGCGTCAATCAGACAGGACATCAAATTAAGATCATTGACTTTGGGCTGGCCAGAA
GGTACAAGCCTCGAGAGAAGCTGAAGGTGAACTTCGGCACTCCTGAGTTCCTGGCCCCAGAAGTCGTCAA
TTATGAGTTTGTCTCATTCCCCACAGACATGTGGAGTGTGGGAGTCATCACCTACATGCTACTCAGTGGC
TTGTCCCCATTTCTAGGGGAAACAGATGCAGAGACCATGAATTTCATTGTAAACTGTAGCTGGGATTTTG
ATGCTGACACCTTTGAAGGGCTCTCGGAGGAGGCCAAGGACTTTGTTTCCCGGTTGCTGGTCAAAGAGAA
GAGCTGCAGAATGAGTGCCACACAGTGCCTGAAACACGAGTGGCTGAATAATTTGCCTGCCAAAGCTTCA
AGATCCAAAACTCGTCTCAAATCCCAACTACTGCTGCAGAAATACATAGCTCAAAGAAAATGGAAGAAAC
ATTTCTATGTGGTGACTGCTGCCAACAGGTTAAGGAAATTTCCAACTTCTCCCTAATCTTCAACTCTGCT
GCTCCAATGGGTCCAGAAATTACTGAGGCAGTGGTGAAGTGAAGAGATGACTCAAACATTTAAATAATT
TGGCTTTTTGGTATTATTGATTCCACTTATTTTGTAAAAATGGTTATGGCTGCTGCCTTCCTTGTGGATG
AAAAGTGGCTGTAAAGAAGCTTCCTAAGAACGTTTTTTTCTGCCTTGTAAGATCACTACGTGTGAAATGC
TCTGAGTACCTTTCAAATATACCTACTTTTGGTGGTAAGTGTAGGGATGCTTTAGGTAGGTACTTTGCAT
CTGTCGAATTTAAATTCTAAACTCACACTGATTAAGGAACTCAGTAGACTACTTTGCAGGGGCCATGTTA
TTCAGTGTTATCTCCTCCAGTACAAAGAATTCCTAGAATTTTGATTTGCTCAGGTGTGAGCTGACATTTT
ATTGTACTACCCCATTCTTGTGTTAAGCCATGTGGATTTAGGACAGTGATCTTCAAACTTGCTTTAACTT
```

Figure 20 (Continued)

```
ATGCTCCCTTTTGAGAATCAGCATCACTTGAAATGTCAAAATATGTCAACTCTCATAGCCAAATCAAAGA
AGTGATCATTTTGACTGTGCTTTTTAAATCTCCACACACCTCCACCTCTCTCCTAATTCTGCCTGTCTTA
ACCCCTCTGTCTTAGTTATAAATTTCTGGTCTTGTAAGTCTGGAAGCTGATAGGCAATTTATGAAAGAGA
TAAGAATGTAATGAGGTTCCGCTTTCTGAGAAACACAGAAATGATACATCCTGAGACATAAAGGAAAGCT
GCTCTTCTGCTGCCTCAGGCTGTAGCACTCTCAATGTTGTCACTCTACACATACACTTTCTATATACATG
TACAGTTGACCCTTGAACAGGGTTTGAATTGCAGTCAACTTAAATGTGGATTTTCTTTCACCTTTGTCAC
CCCTGAGACAGCAACACCATGCTCTCCTCTTCATCCCACTCTGCAGCCTACTCAACAGGAAGATGATGAA
GATGAACACCTTTATGATGATCCACTTTCACTTAATGAATAGTAAACATATGTTTTCCTCCTTATGATTT
TAGTAACTTTTCTCTAGCTTACTTTATTGTAAGAATACAGTATATAAGCTGGGTGTGGTGGCTCATGCCC
ATAATCCCAGCACTTTGGGAGGCTGAGGCAGGCAGATCACTTGAGGTCAGGAGTTCAAGACCAGCCTGGC
CAACACAGTGAAACCCCATCTCTACTAAAAATACAAAAATTAGTGGGGCGTGGTGGCGGATGCCTGTAAT
GTCAGCTACTCTGGAGGCTGAGGCAGGAGAACTGCTTGAACCTGGGAGGTGGAGTTTGCAGTGAGCCAAG
ATTGCACCACTGCACTCCAGCCTAGGCAACAGAGCAAGACTCCGTCTCAAAAAAAAAAAAAAAAAGAAT
ACAGTATATGTATATATACACACACACAAACACACACACACGAACACATATGTGTGTATGGGTATTAA
CTGACTGTTTATATTATTGATAGGGCTTCCAGTCAACATTAGGCTATTAGTAGTTAAGTTTTGGGGAGA
CAAAAGTTATACTCAGATTTTCTACTGCAAGGGGGTAGGCACTCCTAACCCTCACATTGTTCAAGGGTCC
ACTGTACATTTAAACACTTTTCTATATGCATTAGAGTAGCCCTGTCATCCCTTCACTGAAATCATACTGT
TCTCAACATGGCAAGCAACTAACACTTTTTTTTTTTTTGAGACAGGGTCTCACTCTGTTGCCCAGGCTG
CAGTGCAGTGGTGTGATCTTGGCTCACTGTAGCCTCCGCCTCCTGGGCTCAGGCGATCATGAGTACCTGG
GACCATAGGTGCCCGCTACTACACCCAGCTAATTTTTGTATTTTTAGTGGAGATAGGGTTTTGCCATGTT
GCCCAACCTGGTCTTGAGCTCAAGCGATCCACCTGCCCCAGCCTCCCAAAGTGCTGGGATTATAGGTGTG
AGCCACCACACCCAGCTTCAACTAACACATTTACGAACTTGTATACATGTATATTTAGATACTTTACCAA
CTTGTAAAATGGTTAAAGGAGTACTTTATTATGAAAAAATATACAATCTTTAAAATTTCCTTACTTCTAC
ATGATTTTTGTGCTATTCCCATTTTTTTCCTCAGGTGAGCAGCTTTAGTTTTTTATTTTTTTGAGAGAG
TCTTCCTCTGTCACCCAGGCTGGAGTGCACTGGTGTGTTCTTGGCTCACTGCAACCTCTGCCTCCCGGGT
TCAAGTGATCTTGTGCCTCAGCCTCCCAGGTAGCTGGGATTACAGGCGTGTGCTGCCACGCCCAGCTAAT
TTTTGTATTTTTGGTAGAGATGGGGTTTTGCCATGTTGGCCAGGCTGGTCTCGAACTCCTGACCTCAGAT
GATCCACCTGTCTTGGCCTCCCAAAGAGCTGGGAATATAGGCATGAGCCACTGTGCTTGGCCTCAGGTGA
GCAGCTTTAGTCAATGTTGTGAATTTTAGATTTTAATTAGACATGCAACAGTTTCACTACCTTTCAGGAT
TTTTGTCCTGTAACAGAGGCTCTTGCTTTTTGACAGAGAGGTAGGCAGGTGGAGAGGTTATCCTGCTGCT
GCAGTTCTCAAGTTGTTAAGTTTCCTCTGGAAGGCTAACCCTTGTTGGGAACTAACAGTTTCAATACCAG
CAAGTCTAGGCCTGCTCCAAGTTGGTCAGCTGAAGAATGAACATCAGAAGACACAGCTGCTGAAAGTTGT
CCTTTGATGAGACAGTGATAGTGATTTGGTAAAATGTCTTATTTTTAAATGTCAGTTATCTTTCTTTAA
AAGGTTTTTTGAGGGCAGCCTCCAGAAGGAGCTAGAGAGTATATTTTATAGTTCTATTGTGGTTCATACC
CTGTTTTCGACTTAAGATTCTGGAGAATGCTATGAAACATCTCCCCAGAAAAAGACAGTTAATTACCATA
TCTAGAGCAGCACTGCCCAACAAAAATATAGTACAGGCTATACACATAATTAAAACATTTCTAGTAGCTT
CTCTAACAAAACCCATTGAAAGCCAATTTTAATAATTTATATAACTTAGTGTATCAAAATATTTCAATA
TGTAATCAACATAAAATTGAGATACTTTACCAGCTACTAGGGAGGCTGAGGCCAGAGAATCACTTGAACC
CAGGGGGTGGAGGTTGCAGTGAGCCAAGATCACACCATTGAACTCCAGCCTGGGCAACAAGAGCAAAACT
CCGTCTCAAAAAAAAAGAGATATTTTATATTCTTTTTCTCATACTAAGTCTCAAAAATCTGGTATATTTT
ACACTTAAAAACACATGTCAAGGCTAGGCATGGTGGCTCACATCTGTAATCCCAGCACTTTGGGAGGCCA
AGGTGGGCAGATTGCTGGCCAACATGGTAAAACCCCATCTCTAAAAATATAAAAATTAGCTGGGCGTGGT
```

Figure 20 (Continued)

```
GGCGCATACCTGTAATCCCAGCTACTTGGGAGGCTAAGGCACAAGAATCACTTAAACAGGAGGCAGGGGT
TGCAGTGAGCTGAGATCACACCACTGCACTCCAGCCTGGGTGGCAGAGCAAAACTTTGTCCCCACCCCTG
ACAAAAAACAAACAAACAAACAAAACAAAAAAAAACCTGTCAATTCAGATGCTAGGTTTTCATCAGACGT
ACTTAATCTGTATTTAGATTTCTTAAAACTTACTGTGGAAAATGTATTTACATACTCAAGTTGTTTGAAA
CATAACTCACTGTTTTCCAATAACTGAAGTATCCACTTTTACATGTATTAAAATTAAATAAAATTAGAAA
TTCAGTTCTGCAGTTGCACTAGCCACATTTTAAGTGTTTAATAGCCACACGTGGTTAGTGGCATCTATAT
TGGACAGGGCAGATCTAGAGAGAATCCTGTATCTAACAATTTTAATTTTTTTCCCTTTATGCTGTTATTC
CTTACCTAGAGAAACAATTTCCCTCCAAAGTTCCTTTGAGGGGTCTGTTTAGGCCAGGCCAACACAAGTG
ACCTATGTGGATTTTAGCATCCTTTTTTTGAAATTTGAGGTTTTATGAAGCTTGAGTTTTTCTGGATATT
TTTAGTAATTTGCTGGTGTGTACTTAGCTCAAATACTTGATTGCAACTGTGTTGGGTCAACTATTTCTAA
TGGGACTTTTCCATTTGCATGTACAGTCACTGGAAACTGCTGGGCAGAGAAACTCTAAAAGGTAGTTGGG
GCACACTTTTTCCACCTGTCAGATTGGTGAAGAATTGGTGAGGCTGTGGGAAAATGGCATTCTCCCACT
TTTGATGGATATGTATCCAAATAAAAGTCATTCCCATGCTTTCTTTCATCCAGAAATTTTATTTCTAGAA
ATTTATCCCTCCGTACTTGAACAATTGTATAGAGATTTATTCAAAATGATGTTTACTATAGCACTGTTGC
TAATGGCCCAGTAAAAACAACCAACACATGCCTATTAGTTTGGTTTTAGTTAAATGAATTTTGCCACATC
CATGTAGTGGAATACCTCACAGCTGTTATAGATAGATCTAGATATACTGAAAGCCATTTTTTCTTAAATT
ATAGAATGTATATATGGTATCATCCCATTTGTGAAGAGACATATGCTTATATGTGCATTAAAAAACCGTA
GGATATGCAAGAAACTTAACAGTGGAGTGTGAAAAGTGGGTGATTGGGAGAGGGGAATTCCACTTTTCA
TTTATCTTTCTGAACCTTTTGAATCTTTTTTTTTTTTTTTTACAATGAGCATGTATTCCTTTTTTTTT
TTTTCTTTCCAAGATGGAGTCTCACTCTGTTGCCAGGCTGGAGTGCAGTGGCGCAATCTTGGCTTACTGC
AACATCCACCTCCCGAGTTCAAGTGATTTCTCCTGCCTCAGCCTCCCAAGTAGCTGGGACTACAGGCATG
CGCCACCACGCCCAGCTAATTTTTGTGTTTTTAGTAGAGATGGGCTTTCACCATGCTGGCCAGGATGGTC
TCGATCTCTTGACCTCGTGATCTGCCCACCTCGGCCTCCCAAAGTGCTGGGATTACAGGTGTGAGCCACT
GCGCCTGGCCCGCATGTATTACATTTATAATTAAAAATTCACAACTCAATGTCAAGTGTGAACCTTGTGT
TGACCCTGATTTGAGCAAGCAATAAAAAGATATTTTTGAGACATTTAGATTATGAATTTCACATTTGATG
ATAGTTACTATTAATTTTGTGAGGTGTGATATTGGCAATGTGGTTAGATGACTTCAGAGAAAAAGGAAGG
TATAGTTAAGCAAGTATGGCAACATCTAATAACTTGGGTCTAGGTGATGTGTATGGGTTTCATTATACTG
TCCTCTTTACTGTTGTATGTATTTGAAAACATTCATGACAAAAAAACTTTTTAATCAGTTAAATAAACCA
TGAAGAACGGTTAAAGAA

>gi|32698937|ref|NM_182553.1| Homo sapiens cornichon homolog 2 (Drosophila)
(CNIH2), mRNA
CGCAGGATGAGCGATCGGGGCCCGGGCAGCCGGCAGCGGACGCGCCCCCGAGCCCACCGGCCCGCGCCC
CGCGCCCCCACGCCCCGCGGTCCCGGTCCCGGCCGCATCACCCACGTCCCCGAGCCCCACGGGCCAT
GCCCGGCCGGCCCTAAGCGCGGGCCGGGGGCGTCCCCTTGCGCCCGGGCCCCGCGCTGGCGCCCCCGG
GCCGCCGCCCGGCGCGGGGGCCATGGCGTTCACCTTCGCCGCGTTCTGCTACATGCTCACCCTGGTGCTG
TGCGCCTCCCTCATCTTCTTTGTCATCTGGCACATCATAGCCTTTGATGAGCTGCGGACCGACTTCAAGA
ACCCCATCGACCAGGGGAACCCTGCGCGGGCACGCGAGCGTTTAAAAAACATCGAACGCATCTGCTGCCT
CCTGAGGAAGCTGGTGGTCCCAGAATACTCCATCCACGCCTCTTCTGTCTGATGTTCTGTGTGCAGCA
GAGTGGGTGACCCTGGGCCTCAACATCCCCCTCCTCTTCTACCACCTCTGGAGGTACTTCCACCGTCCTG
CAGATGGCTCTGAGGTCATGTATGATGCGGTCTCCATCATGAATGCTGACATTCTCAACTACTGCCAGAA
GGAGTCCTGGTGCAAACTTGCCTTCTACCTGCTCTCCTTCTTCTATTACCTGTACAGTATGGTTTATACG
```

Figure 20 (Continued)

```
TTGGTGAGTTTCTAAGGGGGAAGCCGGCCAGGGAGCGAGCCCAGAACGGACCGGACGCCTGTGCACCCCC
AGCCCTGCCCCTTGGCCGCAGAGGCCTCAGCCCTGGGGAGGGAGGGGGCACTGGTGCCCCCAGCCTCTCC
AACCCCCAAACTGCTGCTGCGGGGAACCCCCCCCACCCCGCCTTCAGAGCCCTCCCCCTTGGACTAGAGC
GGCTGGGCAGAGCTCTAAACAGGGGCAGGGGCTCCTCTGCCAGCCTGTGGGCATGGCAGTCATTCCTGGA
AGGGGCAGGACCTCCGGCCTTGTCCATTTCGGGGGAAACTTGGGCCCTGCCAAGGGGCAGAGCTTGACCC
TGGAAATTCTGGGCCATCCCCCTCCACCCCCACCCTGAGGCTCCCCCTGCAGGTGGGGGGGTACCCGCAC
CGGGAATGAGCAGGCTCAGCAGGGGGGCAGCCCCACCCCTAGTCTGCCCTCCCCTCTCCCCCAGGCTCTT
TCTCCAGCCCTGTCTCCATCTGCCCCAACCTCAGCCCACCTTGTCTCTTGGACCTATTTTCTATGTCGCC
TGGAGGAGTCCGGCACCCCCTCCCCGGCCATTTGTGACAAAATATGAATAAACTACTGCAAATATGTGGG
AAAAAAAAAAAAAAAAAAAAAAAAAAAAAAAAAAAAAAAAAAAAAAAAAAAAAAAAAAAAAAAAAAA

>gi|316983172|ref|NM_182739.2| Homo sapiens NADH dehydrogenase (ubiquinone) 1
beta subcomplex, 6, 17kDa (NDUFB6), nuclear gene encoding mitochondrial protein,
transcript variant 2, mRNA
GTAATAACCGCGCGGCGCTCGGCGTTCCCGCAAGGTCGCTTTGCAGAGCGGGAGCGCGCTTAAGTAAC
TAGTCCGTAGTTCGAGGGTGCGCCGTGTCCTTTTGCGTTGGTACCAGCGGCGACATGACGGGGTACACTC
CGGATGAGAAACTGCGGCTGCAGCAGCTGCGAGAGCTGAGAAGGCGATGGCTGAAGGACCAGGAGCTGAG
CCCTCGGGAGCCGGTGCTGCCCCCACAGAAGATGGGGCCTATGGAGAAATTCTGGAATAAATTTTTGGAG
AATAAATCCCCTTGGAGGAAATGGTCCATGGGGTATACAAAAGAGTATCTTTGTTTTCACTCATGTAC
TTGTACCTGTCTGGATTATTCATTATTACATGAAGTATCATGTTTCTGGTGATACAATTCTGGAGACTGG
AGAAGTAATTCCACCAATGAAAGAATTTCCTGATCAACATCATTAAAGATTATGTAAAAAGTTAAAAGGC
TTATGAGCCTAAGTTTGTTCCTATATTACCATATTTACTGAATTTTCTGGAAAAGTAACTTTAATAAAGT
TTAATCTCAGAAATTGTCATATCTGTTTTCAAGCATTGTACAATTTGAGACTGAGTAATTTAACAATAAG
TAAAAAGTGGACATGCTAAACAAATATGAGAGACTACCTACTTTTTCTGGTCATTCTTGACTTGGAAAAC
GGTATGGAAAAGTATTTAGTTACATGTTTGTTTGTTTTTTTCTTACACAGTACTTACACTAATTTGGTAT
CAGGGTATGCAACAGTGAAATATCACAATAAACAAATGTAAGAACAAAAAAAAAAAAA >gi|353249929|ref|NM_182907.2| Homo sapiens PR domain containing 1, with ZNF
domain (PRDM1), transcript variant 2, mRNA
AGTTTGACGTCGTCAGCCGGCTTGGTCTTCTACCCAGTGACTCAAAGCACTAAAAGTCAGCATAATCGGA
ACTGAAGTCAGTAGCATCGCCCATTTGCCATTCACTGCAGTAGCAAAAGTAGTACTCTGTGGTGGGTTAA
TCGGTTTGAGGCAGCTCCTTAAATGAACATTTGTGTTTCATTTTTCTGTTATTTTCCCGAACATGAAAAG
ACGATAAAACTGAAATGAAAAGATCTATTCCAGAGGGGAGCTTCACCACTTCATTGACGGCTTTAATGA
AGAGAAAAGCAACTGGATGCGCTATGTGAATCCAGCACACTCTCCCCGGGAGCAAAACCTGGCTGCGTGT
CAGAACGGGATGAACATCTACTTCTACACCATTAAGCCCATCCCTGCCAACCAGGAACTTCTTGTGTGGT
ATTGTCGGGACTTTGCAGAAAGGCTTCACTACCCTTATCCCGGAGAGCTGACAATGATGAATCTCACACA
AACACAGAGCAGTCTAAAGCAACCGAGCACTGAGAAAAATGAACTCTGCCCAAAGAATGTCCCAAAGAGA
GAGTACAGCGTGAAAGAAATCCTAAAATTGGACTCCAACCCCTCCAAAGGAAAGGACCTCTACCGTTCTA
ACATTTCACCCCTCACATCAGAAAAGGACCTCGATGACTTTAGAAGACGTGGGAGCCCCGAAATGCCCTT
CTACCCTCGGGTCGTTTACCCCATCCGGGCCCCTCTGCCAGAAGACTTTTTGAAAGCTTCCCTGGCCTAC
GGGATCGAGAGACCCACGTACATCACTCGCTCCCCCATTCCATCCTCCACCACTCCAAGCCCCTCTGCAA
GAAGCAGCCCCGACCAAAGCCTCAAGAGCTCCAGCCCTCACAGCAGCCCTGGGAATACGGTGTCCCCTGT
```

Figure 20 (Continued)

```
GGGCCCCGGCTCTCAAGAGCACCGGGACTCCTACGCTTACTTGAACGCGTCCTACGGCACGGAAGGTTTG
GGCTCCTACCCTGGCTACGCACCCCTGCCCCACCTCCCGCCAGCTTTCATCCCCTCGTACAACGCTCACT
ACCCCAAGTTCCTCTTGCCCCCCTACGGCATGAATTGTAATGGCCTGAGCGCTGTGAGCAGCATGAATGG
CATCAACAACTTTGGCCTCTTCCCGAGGCTGTGCCCTGTCTACAGCAATCTCCTCGGTGGGGCAGCCTG
CCCCACCCCATGCTCAACCCCACTTCTCTCCCGAGCTCGCTGCCCTCAGATGGAGCCCGGAGGTTGCTCC
AGCCGGAGCATCCCAGGGAGGTGCTTGTCCCGGCGCCCCACAGTGCCTTCTCCTTTACCGGGCCGCCGC
CAGCATGAAGGACAAGGCCTGTAGCCCCACAAGCGGGTCTCCCACGGCGGGAACAGCCGCCACGGCAGAA
CATGTGGTGCAGCCCAAAGCTACCTCAGCAGCGATGGCAGCCCCAGCAGCGACGAAGCCATGAATCTCA
TTAAAAACAAAAGAAACATGACCGGCTACAAGACCCTTCCCTACCCGCTGAAGAAGCAGAACGGCAAGAT
CAAGTACGAATGCAACGTTTGCGCCAAGACTTTCGGCCAGCTCTCCAATCTGAAGGTCCACCTGAGAGTG
CACAGTGGAGAACGGCCTTTCAAATGTCAGACTTGCAACAAGGGCTTTACTCAGCTCGCCCACCTGCAGA
AACACTACCTGGTACACACGGGAGAAAAGCCACATGAATGCCAGGTCTGCCACAAGAGATTTAGCAGCAC
CAGCAATCTCAAGACCCACCTGCGACTCCATTCTGGAGAGAAACCATACCAATGCAAGGTGTGCCCTGCC
AAGTTCACCCAGTTTGTGCACCTGAAACTGCACAAGCGTCTGCACACCCGGGAGCGGCCCCACAAGTGCT
CCCAGTGCCACAAGAACTACATCCATCTCTGTAGCCTCAAGGTTCACCTGAAAGGGAACTGCGCTGCGGC
CCCGGCGCCTGGGCTGCCCTTGGAAGATCTGACCCGAATCAATGAAGAAATCGAGAAGTTTGACATCAGT
GACAATGCTGACCGGCTCGAGGACGTGGAGGATGACATCAGTGTGATCTCTGTAGTGGAGAAGGAAATTC
TGGCCGTGGTCAGAAAAGAGAAAGAAGAAACTGGCCTGAAAGTGTCTTTGCAAAGAAACATGGGGAATGG
ACTCCTCTCCTCAGGGTGCAGCCTTTATGAGTCATCAGATCTACCCCTCATGAAGTTGCCTCCCAGCAAC
CCACTACCTCTGGTACCTGTAAAGGTCAAACAAGAAACAGTTGAACCAATGGATCCTTAAGATTTTCAGA
AAACACTTATTTTGTTTCTTAAGTTATGACTTGGTGAGTCAGGGTGCCTGTAGGAAGTGGCTTGTACATA
ATCCCAGCTCTGCAAAGCTCTCTCGACAGCAAATGGTTTCCCCTCACCTCTGGAATTAAAGAAGGAACTC
CAAAGTTACTGAAATCTCAGGGCATGAACAAGGCAAAGGCCATATATATATATATATATATATCTGTATA
CATATTATATATACTTATTTACACCTGTGTCTATATATTTGCCCCTGTGTATTTTGAATATTTGTGTGGA
CATGTTTGCATAGCCTTCCCATTACTAAGACTATTACCTAGTCATAATTATTTTTTCAATGATAATCCTT
CATAATTTATTATACAATTTATCATTCAGAAAGCAATAATTAAAAAAGTTTACAATGACTGGAAAGATTC
CTTGTAATTTGAGTATAAATGTATTTTTGTCTTGTGGCCATTCTTTGTAGATAATTTCTGCACATCTGTA
TAAGTACCTAAGATTTAGTTAAACAAATATATGACTTCAGTCAACCTCTCTCTCTAATAATGGTTTGAAA
ATGAGGTTTGGGTAATTGCCAATGTTGGACAGTTGATGTGTTCATTCCTGGGATCCTATCATTTGAACAG
CATTGTACATAACTTGGGGGTATGTGTGCAGGATTACCCAAGAATAACTTAAGTAGAAGAAACAAGAAAG
GGAATCTTGTATATTTTGTTGATAGTTCATGTTTTTCCCCAGCCACAATTTTACCGGAAGGGTGACAG
GAAGGCTTTACCAACCTGTCTCTCCCTCCAAAAGAGCAGAATCCTCCCACCGCCCTGCCCTCCCCACCGA
GTCCTGTGGCCATTCAGAGCGGCCACATGACTTTTGCATCCATTGTATTATCAGAAAATGTGAAGAAGAA
AAAAATGCCATGTTTTAAAACCACTGCGAAAATTTCCCCAAAGCATAGGTGGCTTTGTGTGTGTGCGATT
TGGGGGCTTGAGTCTGGGTGGTGTTTTGTTGTTGGTTTTGTTGCTTTTTTTTTTTTTTTTTAATG
TCAAAATTGCACAAACATGGTGCTCTACCAGGAAGGATTCGAGGTAGATAGGCTCAGGCCACACTTTAAA
AACAAACACACAAACAACAAAAAACGGGTATTCTAGTCATCTTGGGGTAAAAGCGGGTAATGAACATTCC
TATCCCCAACACATCAATTGTATTTTTTCTGTAAAACTCAGATTTTCCTCAGTATTTGTGTTTTACATT
TTATGGTTAATTTAATGGAAGATGAAAGGGCATTGCAAAGTTGTTCAACAACAGTTACCTCATTGAGTGT
GTCCAGTAGTGCAGGAAATGATGTCTTATCTAATGATTTGCTTCTCTAGAGGAGAAACCGAGTAAATGTG
CTCCAGCAAGATAGACTTTGTGTTATTCTATCTTTTATTCTGCTAAGCCCAAAGATTACATGTTGGTGTT
CAAAGTGTAGCAAAAAATGATGTATATTTATAAATCTATTTATACCACTATATCATATGTATATATATTT
```

Figure 20 (Continued)

```
ATAACCACTTAAATTGTGAGCCAAGCCATGTAAAAGATCTACTTTTTCTAAGGGCAAAAAAAAAAAAAA
AAAAAAAGAACACTCCTTTCTGAGACTTTGCTTAATACTTGGTGACCTCACAATCACGTCGGTATGATTG
GGCACCCTTGCCTACTGTAAGAGACCCTAAAACCTTGGTGCAGTGGTGGGGACCACAAAACAACCAGGGA
GGAAGAGATACATCATTTTTTAGTATTAAGGACCATCTAAGACAGCTCTATTTTTTTTTGCCACTTTAT
GATTATGTGGTCACACCCAAGTCACAGAAATAAAAAACTGACTTTACCGCTGCAATTTTTCTGTTTTCCT
CCTTACTAAATACTGATACATTACTCCAATCTATTTTATAATTATATTTGACATTTTGTTCACATCAACT
AATGTTCACCTGTAGAAGAGAACAAATTTCGAATAATCCAGGGAAACCCAAGAGCCTTACTGGTCTTCTG
TAACTTCCAAGACTGACAGCTTTTTATGTATCAGTGTTTGATAAACACAGTCCTTAACTGAAGGTAAACC
AAAGCATCACGTTGACATTAGACCAAATACTTTTGATTCCCAACTACTCGTTTGTTCTTTTTCTCCTTTT
GTGCTTTCCCATAGTGAGAATTTTTATAAAGACTTCTTGCTTCTCTCACCATCCATCCTTCTCTTTTCTG
CCTCTTACATGTGAATGTTGAGCCCACAATCAACAGTGGTTTTATTTTTTCCTCTACTCAAAGTTAAAAC
TGACCAAAGTTACTGGCTTTTTACTTTGCTAGAACAACAAACTATCTTATGTTTACATACTGGTTTACAA
TGTTATTTATGTGCAAATTGTCAAAATGTAAATTAAATATAAATGTTCATGCTTTACCAAAAT

>gi|347300412|ref|NM_197967.2| Homo sapiens BH3 interacting domain death agonist
(BID), transcript variant 3, mRNA
GAAGGAGGAAGCGCGCGGGGCGCCATAAGGAGGAAGCGGGTAGTCGACCGTGTCCGCGCGCCTGGGAGAC
GCTGCCTCGGCCCGGACGCGCCCGCGCCCCGCGGCTGGAGGGTGGTCAACAACGGTTCCAGCCTCAGGG
ATGAGTGCATCACAAACCTACTGGTGTTTGGCTTCCTCCAAAGCTGTTCTGACAACAGCTTCCGCAGAGA
GCTGGACGCACTGGGCCACGAGCTGCCAGTGCTGGCTCCCAGTGGGAGGGCTACGATGAGCTGCAGACT
GATGGCAACCGCAGCAGCCACTCCCGCTTGGGAAGAATAGAGGCAGATTCTGAAAGTCAAGAAGACATCA
TCCGGAATATTGCCAGGCACCTCGCCCAGGTCGGGGACAGCATGGACCGTAGCATCCCTCCGGGCCTGGT
GAACGGCCTGGCCCTGCAGCTCAGGAACACCAGCCGGTCGGAGGAGGACCGGAACAGGGACCTGGCCACT
GCCCTGGAGCAGCTGCTGCAGGCCTACCCTAGAGACATGGAGAAGGAGAAGACCATGCTGGTGCTGGCCC
TGCTGCTGGCCAAGAAGGTGGCCAGTCACACGCCGTCCTTGCTCCGTGATGTCTTTCACACAACAGTGAA
TTTTATTAACCAGAACCTACGCACCTACGTGAGGAGCTTAGCCAGAAATGGGATGGACTGAACGGACAGT
TCCAGAAGTGTGACTGGCTAAAGCTCGATGTGGTCACAGCTGTATAGCTGCTTCCAGTGTAGACGGAGCC
CTGGCATGTCAACAGCGTTCCTAGAGAAGACAGGCTGGAAGATAGCTGTGACTTCTATTTTAAAGACAAT
GTTAAACTTATAACCCACTTTAAAATATCTACATTAATATACTTGAATGAAAATGTCCATTTACACGTAT
TTGAATGGCCTTCATATCATCCACACATGAATCTGCACATCTGTAAATCTACACACGGTGCCTTTATTTC
CACTGTGCAGGTTCCCACTTAAAAATTAAATTGGAAAGCAGGTTTCAAGGAAGTAGAAACAAAATACAAT
TTTTTTGGTAAAAAAAAAATTACTGTTTATTAAAGTACAACCATAGAGGATGGTCTTACAGCAGGCAGTAT
CCTGTTTGAGGAAAGCAAGAATCAGAGAAGGAACATACCCCTTACAAATGAAAAATTCCACTCAAAATAG
GGACTATCTATCTTAATACTAAGGAACCAACAATCTTCCTGTTTAAAAAACCACATGGCACAGAGATTCT
GAACTAAAGTGCTGCACTCAAATGATGGGAAGTCCGGCCCAGTACACAGGGGCTTGACTTTTTCAACTT
CGTTTCCTTTGTTGGAGTCAAAAAGAACCACTTGTGGTTCTAAAAGGTGTGAAGGTGATTTAAGGGCCCA
GGTCAGCCACTGTTTGTTTACAAAATCAGGTAACTAACTGCATACACTTTTTCTCTTTCCATGACATCAA
GACTTTGCTAAAGACATGAAGCCACGGGTGCCAGAAGCTACTGCGATGCCCCGGGAGTTAGCCCCCTGGT
AATAGCTGTAAACTTCCAATTTCTAGCCATACGCTCAGCTCATCCATGCCTCAGAAGTGCATCTGGAGAG
AACAGGTTTCTAAGCATAAAAGATGAAAGAGCAGTTGGACTTTTTAAAAATTCAGCAAAGTGGTTCCCTC
TCTTAGGGACAGTCAAAACCAAGTCACTTAGGTAGTACCAAAATAAATAAGGAAAAGCTTAGCTTTAGAA
ACAGTGCAACACTGGTCTGCTGTTCCAGTGGTAAGCTATGTCCCAGGAATCAGTTTAAAAGCACGACAGT
```

Figure 20 (Continued)

```
GGATGCTGGGTCCATATCACACACATTGCTGTGAACAGGAAACTCCTGTGACCACAACATGAGGCCACTG
GAGACGCATATGAGTAAGGGCACTGACGGACTCATGATTTCTTCTTACCAGATGCTTTCCTGTTCTTTAA
GAGTTTAAAATCATCAGAAAGGAAAAACAAACTCTATATTGTTCAGCATGCAATACATACCACGCTAGGG
CTGGCTCAATTGAAAGTGGGCAAAAGCTTACAAATACTAAAAAGAAGTGCTGCCGCGCAGTGTGGAGGCC
ACTGTTTGGAAATAAATCTTCCTAACACTACAAAAAAAAAAAAAAAAA
```

>gi|158508494|ref|NM_198081.3| Homo sapiens sex comb on midleg-like 4
(Drosophila) (SCML4), mRNA
```
GAATGCATTAGTCTAATGAGATGTTTGCAGCTGGAGCGCAGGGCTGCTGGAGACTAACTGTGAGCTACTA
ACACGGGTGGAAGATAGCTTTTGCAATACTCGGTTTGCATGTGCTGAAAGTCATCTGTCTTCTGAGTCAA
CACTCCCGACCTGGTAAACAACCTGCTCAGGGCTCTGGTGAACAAGCTGTAGCACCTCTTCTGCCTGTGA
GCGATTTGTCACCTCATTCTGTAAGACTGGCACCAGCAGAAATGCAGTCTCAAAGGATCCCGGGGAGAAA
GCGAGGCCGACCCTCACTTCACTCCACGCCTATGAAGATGGCAGTTCATAACCTTTATTCTGCTTCAGCT
GGCTCTTTACCAGCAGTGAAGATCCCAAAGAAAAGAGGGCGGAAACCCGGGTACAAGATCAAGTCTCGGG
TTCTCATGACTCCCTTAGCCCTCTCACCTCCGCGGAGTACCCCAGAGCCCGACCTCAGCTCCATCCCTCA
GGACGCAGCCACGGTCCCCAGCTTGGCGGCCCCACAGGCTCTCACAGTCTGCCTCTACATCAACAAGCAG
GCCAATGCGGGGCCCTATCTGGAGAGGAAGAAGGTGCAGCAGCTCCCGGAGCATTTTGGGCCCGAGCGGC
CATCGGCGGTGCTGCAGCAGGCCGTCCAAGCCTGCATCGACTGCGCCCACCAGCAGAAGCTGGTCTTCTC
CCTGGTCAAGCAGGGCTATGGTGGTGAGATGGTGTCAGTCTCGGCTTCCTTTGATGGCAAACAGCACCTG
CGGAGCCTGCCTGTGGTGAACAGCATCGGCTATGTCCTCCGCTTCCTCGCCAAGCTGTGCCGAAGCCTCC
TGTGCGATGACCTCTTCAGCCACCAGCCCTTCCCCAGGGGCTGCAGTGCCTCTGAGAAAGTCCAGGAGAA
AGAGGAAGGGAGGATGGAATCAGTCAAGACAGTCACCACCGAAGAGTACCTGGTGAACCCTGTGGGCATG
AACCGCTACAGCGTGGACACCTCCGCCTCCACCTTTAACCACAGGGGCTCCTTGCACCCCTCCTCCTCGC
TGTACTGCAAGAGGCAGAACTCTGGAGACAGCCACCTTGGGGGTGGTCCTGCTGCCACCGCTGGTGGTCC
CCGCACTAGCCCCATGTCTTCTGGTGGCCCCTCGGCACCTGGGCTGAGGCCTCCAGCCTCCAGCCCCAAG
AGAAACACGACCTCTCTTGAAGGAAACAGATGTGCCTCAAGCCCTTCTCAGGATGCGCAGGATGCCAGGC
GGCCACGGAGCAGGAACCCCTCCGCCTGGACTGTGGAGGACGTGGTGTGGTTTGTGAAGGACGCCGACCC
ACAGGCTCTGGGGCCTCACGTGGAGCTCTTCAGAAAGCACGAGATTGATGGCAACGCTCTGCTGTTGCTG
AAGAGTGACATGGTCATGAAGTACCTGGGCCTGAAGCTGGGACCTGCACTGAAACTCTGCTACCACATTG
ACAAACTGAAGCAAGCCAAGTTCTGACTTTTTTAAAAAGACAGAAGCGAAACCCAAAACAACAGATCCCA
AGATTATCTTCTGCCTTACCAATATCCCGCCAACATCACAAACTAGACTCTCCTCTTAAAATTAACAGCC
ACAGAGACGTGGTCTTTTTATAAAACTTGTGAATCTTTGCCTTTTGAAGAATTTAACATGGACCTTTTCG
AGAGGCTCCTCTGTGTTCATAATTTGCCAAAAAATTACAAAAGCCTGTGATTTTTAACATCCCTGTTATG
CTGGTTTCTCTTAAAGTGGGTCCTATTTGCATAACGAGAGAGTGGGGAACTGAATGCTTATGCCCAAGGA
GAGTTCTGGAGGGTTCAAAGGATGAAAGAAGGACCTTTGTCCCTGCGGTCTCTGCAGGGACAACCCCCTC
AGCACCATCTGCCTCTAACTCTGACCTGGGGACCTATCCATGTGAGCCTTGTTTGCCTCAGCTCTGGAAG
CTGACTTCTGAAGATGACTGCCTCACCTTGCACTGTCTGGAAAACTTGAATTATTTTACGCCGTGAAAGA
AAAAGGAAAAAAAAAAAATCTTTTCTGTTCCTAGAAAATCTGAAGTACTGTGTTTCTCCGCTAGAGGGC
AGACTGCTAATGAAATTTCAGGACCCTCACTGACTGCAGTAGCAGGATTGTTCAGTACTGAGTGGATGGG
TTAGGGTGTCTGTGAACAAGATCTAGCCCACACAGAAACAGGGGATTTATTCCACAGTTAGCACCACAGA
TTGCGACTTGGGAAGAAACCATCAGCTAGAGGGGTCTAGTTCGTATCCAATCATTATTGACTGACTGACT
GATACTCAACTAGCAAAGGCAAGAATTTGGAAGCACGCTCTACCCAGATGGGACTTTGGAGTTCCTTCCC
```

Figure 20 (Continued)

```
TTCCAGAGTCCTTATTGAGGTGTTGAAGTGTTGGCATGCCGAAGAATCTTAGTGACATTTAGCCATGGGT
GTTTCTTTAAAAAAGGAAAAGAAAATGTCTCAACGAAGCTTTGAAATGGGAGAGTGTTGATTTCTAGTTA
CATTGCTGGGTTATGTAGTTGTATCTGTGGCTAATTTTTCTAGTCCTCAACAAATACACAGACATGCTAT
TATGGGGTTTAATTCAATTTACAAATAGGTTTTCCTTCCTCACAGTGGAGTAATAGAAAAAATTGATTTT
CTGCTCCTTTGCAGCTGTGTCCAGAGACGGACAATGAATCCACAATTTATTAGGCAGAGGCACAACTTCT
CCACCATTCGTTTTATCCTTCTCTTTTCTCTGTTTCCCTCCACCTCTCTTCTTCTTTCACACTGAGC
AGAAAACATATCTTCAAAATGAATTCGCCTTTGCCATGTGCATATTCTCTTCCTTAAAAGGACATCAACA
GTGTTGGAGATGAGGAGATGAACATTAGATTTTGGAATTTCTGGGAGGGAGAGGGTTAGGGATGACTCAG
GGCCTCCCTTCGCCCAAAGGTGAATCAGAAAAGGCACCCCTTTCTCTGGGATACAACCTGAGCAGGGGTC
TCAGCTGGCAAGTGGAGCAGGGTGGGGGCTCAACCTCCTCACCGCTTGATCAGCTGCCGTTGTACAGAGC
ATGACCTGTATAACCTTGAGGGCAGCCCTGGGTAGATCTGCAGAGTGACCCTCTATATAGTTAGAATCCA
GATGAAGGCCATAAGAAATAGTCCATGCCATGCCGTTAGGCCCACTTTCATGTGCAGTACTTGAGAAAGC
ACATCGTAGCCTCCTTTTCAGACACACAAATGGCGGCTGGACTGAGAGCATGGCAGAGAAGGGGAGGAGG
AGAATGTACTAAACTTGCTCACTGAATTGAGCTTGAGTTATTAGATTGTAGAAGAGCTTGATGTCTGGTG
ATTTTGTTACAGGAAGGGGGTCCCGATCCAGACCCCAAGAGAGGGCTCTTGGATCTCATGCAAGAAAGAA
TTCAGGGTGAGTCCATAAAGTAAAGTGAAAGCAAGTTTATTAAGAAAGTAAAGGAAGGAAAGAATGGCTA
CCCCATAGTCAAAGCAGCTCTGAGGGCTGCTGGTTGCCCATTTTTATGTTTATTTCTTGATATGCTAAAC
AAGGGGTGGATTATTCATGCCTCCCCCTTTTAGATCATATAGGGTAACTTCCTGATGTTGCCATGGCATT
TGTAAACCGTCATGGCACTGGTGGTAGTATAGCAGCGAGGACAACCAGAGGTCACTCTCGTTGCCATCTT
GGTTTTGGTGGGTTTTAGCCAACTTCTTTACTGCAACCTGTTTTATCAGAAGGTCTTTATGACCTATATC
TTGTGCTGACCTCCTGTCTCATCCTGTGACTCAGAATGCTTTAGCCATCTGGGAATGCAGCCCAGTAGGT
CTCAGCCTCATTTTACCCAGCTCCCATTCAAGATGGAGTTGCTCTGGTTCAAATGCCTCTGACAGGTTCA
GCACCTGAGAAAAGTACCTTGAATCAGGCCTTGGGGCAGAGTCTTCAAGATTTTAAGGTGATAGGGCCTG
TCTCTTAAGAATTTATTAATCGTAAGTGCTCACTGCTGGTTTAGAGTTAGATACATTTCCCTCAAAACAG
CCATGGGCAGGTTATGTACTCAGAACTGCCAGGGTGAAAACAATGAGATCCAGAAAAATCCCACAACAAT
CCAGGTTTTTCACTCCTCTTTTTTTTCTCAATCTTCCGATACTTGTGGTACCTCTTCCATCAACAGATAC
CTCATGTAGTGACTTCCAGTATCAAGTTTTCAAAACTTCCTACCCACCCTCATCAGTGCCTCCTTCACTA
CAGAGTCACAAACATTGGTGCTCTCAAATAAAAATCAGCCCCAAACAATGTCAAAGAGATCCCTTGAGTA
GTTTTCAGGCGAGAGATATGTTCTCATTTCAAGTCTTGGAGAAAACTGGATCCATGTTCACGTGGAACTT
CTCTCGCGGAGGTGCTATCTCATTTTGCATTAAACTTTAAGCAGGACAGATTGCTGAAGCCATGATATTT
AAGGTTTGACTTTTTAAAAATCTCATTACTCTTAAAATAAATGCTGCCACATCAGAAAAA

>gi|209571514|ref|NM_198152.3| Homo sapiens urotensin 2 domain containing
(UTS2D), mRNA
AACTCAAGGCATAAGGCGATCCAGCCACCTAAGATCTCAGCAAAAAAAAGCTAGGTCCTGAGGCAGCTAGT
GGAAAAACAAGAGAAGGGAAGTCAAAAGGCTACTTGCTGTCAGCTAAAGCCAGACAACCTCTCCTGTTTC
ATCTCCTGGCAACAGAATGCATCCTCCTTTTGGGAAACTGCCTCTTTCCCCACTCCTCAGAGTAAATCTT
GCTGCTGCTCACTCTTTGGGTCTGCACTGCCCATAAGAGCTGTAGCACTCACCGCGAAGGTCTGCAGCTT
CACTCTTGAAACCAGAGAGACCACGAACCTACCGGGAGAAATGAACAAATTCCGGACGCACCATCTTTAA
GAACTGTAACACTCACTGCGAGGATCTGCGGCTTCATTCTTTAAGTCTGTGAGACCAAGAACCCACCAAT
TCCGGCACACTAATATGCTGTTGGAAACTGGCTATATGGAAAGGCTATGTGGAAGAAAACAAACACCCCA
GCCAACATAATGGAGCTCCCAGCTGACAGCTGACATCTAGCTGATTGCCAACCACTTTGGAAACTGATCT
```

Figure 20 (Continued)

```
TCAAAACCCACTTGAGCTATGTCAAGAGAAGCCACCTGTGACACAGAAGCAGAAGGATCCAAGTCAAAGG
AGTTTATTTGGGAGGAAATAGCACGAGAGAATGATCATTCGTAACTGAGGCACACTTGCCTTTTGCAACT
AAGCTCTACTGAATTCCAAAGCTATAGAAATATCCATCTTGACCTGGAAAGTCTGTTTCTTTGCTAGTCC
AGAAGGTTTTTTTTAACATGAACAAGATCCTCTCAAGCACTGTTTGCTTTGGACTCCTAACTTTGTTATC
CGTGTTGAGTTTTTTACAATCTGTGCATGGACGACCATATCTTACCCAAGGAAATGAAATATTTCCAGAT
AAAAAATATACAAATCGTGAGGAACTATTGCTGGCTCTACTGAATAAAAATTTTGATTTCCAAAGACCTT
TCAACACTGACCTAGCCTTACCTAACAAACTGGAAGAACTTAACCAGCTGGAAAAGCTAAAAGAACAGCT
AGTGGAGGAGAAGGATTCTGAGACGTCCTATGCTGTAGATGGTCTATTCTCTTCTCATCCTAGCAAACGA
GCTTGCTTTTGGAAATACTGTGTTTAAAGCTTTTTCTCTGGATGCAAAAAAAGATAAGAATATCAGGAAA
ATATATGTATCTACTCACTCTGCTGTAGGCAGACCCCCTGAAACTATTGCTGTGGAATAAAAGATGAAAT
GCTCCTGATTATTGTAAATACAAAATTGCATGCGGGATTGTGTAAAGACAATGCCAGGTTGGACTGCCAG
AATGAGCCAACAGCACTTGCTTCCCCCTGTAGAGAGCCTATGAATGGACGTGCAGTCAGGGAGGTTTCAT
ATCACCAAGATTCCTATCCCAGAAAAGCAGATGTTCATAGCTCTGGGAATGGAATGCGCCCCTCGTGGAG
AGCCTATAAACGGATGCATGGAAGGCGCCTGTCCATATGGATAAGATAGGGTTGTAAACGTCCTCATCTT
GCCATGGCTCTTCTAGGCCTCTTTAGGGTTAAGGCATATTTCCTTCTGAGAATTTCTGGTCTAAGCGGTT
GTCTAGCTTCATGTCCTGTTTCCATGGATTGTTTGTAACCAGCTTTTGTTACAATTGTTACTGCTGATTA
ATATCTTGCTAATCATAGGTTATGGAAAGATTGTGTTTCTGTTTTAAGGCTCTGTTAGAAATTACACACA
CAGTATATTGTAAATTCTTATCTCTGTATACTGTACTTCTACATACAAATGTACTGTACTTCTACATACA
AATGTTATGTTAAAGAATTACTTCATCCCCATGTGACCATCTCACCTCATAATCAAATGACCCTAAATCC
CTCATTAACCTACCCCTGCCCTTGCTAAACTTAATAATAAATGCTGGTATATCCAGTGCATTGTTGGCAC
CATGGGACCAGAAGGTGGTGACCCCCCTGGACCCAGCTTTCACTATCTTGTGTGTGTCTGTTATTTCTCA
ACCTGCTGATCCGCCTGGGAACAAAGAGCCCCGTTGCATTGCGGGCTACTGGCCAGATCCCGCAATACTC
TGCTATTTAAAATTGTAGCTGTTTCAATCATAAAGAAACTGGCATTTATTATGCATATGATTTTTTCACC
TTGTTCTTGTTACTAAGTCAATTATGATAAGCTTAAGGTTTATGTTGTGAATAATCACTAATCAGTTGCA
CTTTTGAAGGTATGTCACTATCAAAATGGTTTTGTAGAGCTAGAGTTGAAAATGCTGTATCTATTGTATG
CTTTCCATAAATTCATTGCTTATGTAAAGTTTTGTCCTGTTGTGACTATGCTGTTGAACTATTAATTAAA
ACATTTTGAAAAGCATCTTGGAAAGTTA

>gi|217416408|ref|NM_198276.2| Homo sapiens transmembrane protein 17 (TMEM17),
mRNA
ACTGGCAAATGTGAGGGCTCCTTGTATCGCAGTCCAACCCCAGCTCATTTCTTAGTATAGGTTTGTTTTT
AGGATGGTCGAGCTCAAAGCAGAACTAAGGGATCTGCCGTTTTGTACACGGCCGAGGCGCGCGGCTCCCT
GGGCCTGGAACGCGCTCTGAGCGCGCCGGTCCCTTCCAGGTTGCGCGGGCTCCGGACGAGACCCAGCCCA
GCCGGGCAGCCCCGCGCGCTCCCGGGTCCCGCCGGCCTCGCGCCGCCCGGTTGCCGTGGGAACCACGGAG
CCTCGGAGCGCCCGCAGACTAGCCCGTGTCTGAGGGGGTGAGGGATACTGAGGCCCAGGCATGGAGCTGC
CGGATCCGGTGCGCCAGCGGCTGGGAAACTTCAGCCGGGCCGTGTTCAGTGATTCCAATCGGACCGGTCC
AGAGTCCAATGAGGGTCCGGAAAATGAAATGGTCTCCAGTTTGGCACTGCAGATGTCACTTTATTTTAAT
ACCTACTATTTCCCACTGTGGTGGGTGAGCAGCATTATGATGCTTCACATGAAGTATTCAATCTTACCTG
ACTACTACAAATTCATTGTGATCACTGTTATCATCCTAATAACCTTAATTGAAGCCATCCGGTTGTATCT
GGGCTACGTGGGTAACCTACAGGAGAAGGTTCCTGAGTTGGCTGGCTTTTGGCTTTTGAGCCTTCTATTG
CAGTTACCTTTAATTCTTTTCTTGCTCTTTAATGAAGGCCTAACAAATCTGCCCTTGGAAAAAGCGATAC
ATATCATCTTCACTCTCTTCCTTGCTTTCCAAGTTGTTGCAGCATTTCTTACCTTAAGGAAAATGGTTAA
```

Figure 20 (Continued)

```
TCAGTTGGCAGTTCGTTTCCACCTCCAAGACTTTGACCGGCTCTCTGCAAACAGAGGAGACATGAGAAGG
ATGAGGTCATGTATAGAAGAGATCTGATCCAGTGTTGTTGAGTGAAAATCTGACAGATCATTCTAGAGAC
TGTAAGAGTTAGGAAAATATCAGAGCTCTGAGAAAAGGGACAAAGCAAGTGTTTTGAATTGTATATGCTC
TCACTCTGAAATTCCAAGGTTGGGGGCAATGATGAAACTTTGTACAGTATATGAAACAGTATATTAACCC
TAAAACCTAGATGTTGTCCACCTGATGCCAAATTTCTTAATTTTTTTTGATGTTGTTGTCTTTTTCAGGA
GTGTAGAAATCTATGTATTGGTGGTTGTCATTTGCCAGCTCTCTCGTAGCATTTCTGGTTAGAATCTTTA
ACTAGAGATGTATACATTTCTTTAAAACTTGTTGGTTATCCATGTCTTGTCTGTACATATGACCATGTTT
CTTGACATGGAAATACCAGTCAGTGTTCCTATGTATTTGTCTATATTTGTAAACCAAGAGACCGGCTGGG
TGTGGTGGCTCACGCCTGTAATCCCAGCACTTTGGGAGGCCGAGGTGGGCAGATCATGAGGTCAGAAGAT
CGAGACCATCCTGGCTAACACGGTGAAACCCAGCCTCTACTAAAAATACAAAAAAAAAAAAAATTAGCTA
GGCGTGGTTGCAGGCACCTGTAGTCCCAGCTACTTGGGAGGCTGAGGCAGGAGAATGGTGTGAACCCAGG
AGGCAGAGCTTGCAGTGAGCCGAGATCAAGCCACTGTACTCCATCCTGGGTGACAGAGCAAGACTCCATC
TCAAAAAAATAAATAAATAAAAAATAAAACAAGAGACCAAATTTTCATGTCTGCTAGGGTTAAATTCTAA
CCCTAATATTAGCTGTTATACTGAGATGAAGAAGAAAACAGGTGGATTGCCTTGGTATTTAGGAAATATT
TTTGTTATAAAATTACAACTTTCATAAAACCATATTCAGTATTTGTAATGGTGGTATACAAAATGCTTTT
ACAATAAATTATTAAATATTTAAGGTATCAGCAGC

>gi|38348291|ref|NM_198489.1| Homo sapiens coiled-coil domain containing 84
(CCDC84), mRNA
GCCGCCGGATGGCGTAGGATCGGCCGCTGGTGGTGGTGATACCGGGTACCCGGGCTATGGCGCCGGCGCA
GCGCTGCCCTCTGTGCCGCCAGACCTTCTTCTGTGGTCGCGGGCACGTTTACAGCCGCAAGCACCAGCGG
CAGCTGAAGGAGGCTTTGGAGAGGCTCCTGCCCCAGGTGGAGGCGGCCCGCAAGGCCATCCGCGCCGCTC
AGGTGGAGCGCTATGTGCCCGAACACGAGCGATGCTGCTGGTGCCTGTGCTGCGGCTGTGAGGTGCGGGA
ACACCTGAGCCATGGAAACCTGACGGTGCTGTACGGGGGGCTGCTGGAGCATCTGGCCAGCCCAGAGCAC
AAGAAAGCAACCAACAAATTCTGGTGGGAGAACAAAGCTGAGGTCCAGATGAAAGAGAAGTTTCTGGTCA
CTCCCCAGGATTATGCGCGATTCAAGAAATCCATGGTGAAAGGTTTGGATTCCTATGAAGAAAAGGAGGA
TAAAGTGATCAAGGAGATGGCAGCTCAGATCCGTGAGGTGGAGCAGAGCCGACAGGAGGTGGTTCGGTCT
GTCTTAGAGCCTCAGGCAGTGCCAGACCCAGAAGAGGGCTCTTCAGCACCTAGAAGCTGGAAAGGGATGA
ACAGCCAAGTAGCTTCCAGCTTACAGCAGCCCTCAAATTTGGACCTGCCACCAGCTCCAGAGCTTGACTG
GATGGAGACAGGACCATCTCTGACATTCATTGGCCATCAGGATATACCAGGAGTTGGTAACATCCACTCA
GGTGCCACACCTCCCTGGATGATCCAAGATGAAGAATACATTGCTGGGAACCAAGAAATAGGACCATCCT
ATGAAGAATTTCTTAAAGAAAAGGAAAAACAGAAGTTGAAAAAACTCCCCCCAGACCGAGTTGGGGCCAA
CTTTGATCACAGCTCCAGGACCAGTGCAGGCTGGCTGCCCTCTTTTGGCCGCGTCTGGAATAATGGACGC
CGCTGGCAGTCCAGACATCAATTCAAAACTGAAGCTGCAGCAATGAAGAAGCAGTCACATACAGAAAAAA
GCTAATCATGCTCTCTACCAACTACCATGAGGCTAAAAGCAAAGTCAACAAACCCCTATTATACCTTCCA
CCAAATTCTTTATCATTGTCTTTCTTAGGAAACAGACATACTCATTCATTTGATTTAATAAAGTTTTATT
TTTCCAAATGTA >gi|150378490|ref|NM_199054.2| Homo sapiens MAP kinase interacting
serine/threonine kinase 2 (MKNK2), transcript variant 2, mRNA
CGGCTCCTCTCAGCGGCGGTGGCCCAGGTAGAGGGGTCCGCGCTGGCGGCGGCGGCGCTGTTCCCCG
CGCGGTCCGCGGAGCGGGGTCCGGGCTGCGCGACGTGGGGCGGCGGCGGCACTGCGGCCCCGGCCCAAGC
```

Figure 20 (Continued)

```
CCGACCCCGGGTCCCCTCCTCGGCCGCCCCCGCCCGGCCGCCCGCCCTCGGGCCTCCCCCGGGCCCTC
GGTCCCCTCCCCGCTGGCGGGGCCCGGACAGAAGATGGTGCAGAAGAAACCAGCCGAACTTCAGGGTTT
CCACCGTTCGTTCAAGGGGCAGAACCCCTTCGAGCTGGCCTTCTCCCTAGACCAGCCCGACCACGGAGAC
TCTGACTTTGGCCTGCAGTGCTCAGCCCGCCCTGACATGCCCGCCAGCCAGCCCATTGACATCCCGGACG
CCAAGAAGAGGGGCAAGAAGAAGAAGCGCGGCCGGGCCACCGACAGCTTCTCGGGCAGGTTTGAAGACGT
CTACCAGCTGCAGGAAGATGTGCTGGGGAGGGCGCTCATGCCCGAGTGCAGACCTGCATCAACCTGATC
ACCAGCCAGGAGTACGCCGTCAAGATCATTGAGAAGCAGCCAGGCCACATTCGGAGCAGGGTTTTCAGGG
AGGTGGAGATGCTGTACCAGTGCCAGGGACACAGGAACGTCCTAGAGCTGATTGAGTTCTTCGAGGAGGA
GGACCGCTTCTACCTGGTGTTTGAGAAGATGCGGGGAGGCTCCATCCTGAGCCACATCCACAAGCGCCGG
CACTTCAACGAGCTGGAGGCCAGCGTGGTGGTGCAGGACGTGGCCAGCGCCTTGGACTTTCTGCATAACA
AAGGCATCGCCCACAGGGACCTAAAGCCGGAAAACATCCTCTGTGAGCACCCCAACCAGGTCTCCCCCGT
GAAGATCTGTGACTTCGACCTGGGCAGCGGCATCAAACTCAACGGGGACTGCTCCCCTATCTCCACCCCG
GAGCTGCTCACTCCGTGCGGCTCGGCGGAGTACATGGCCCCGGAGGTAGTGGAGGCCTTCAGCGAGGAGG
CTAGCATCTACGACAAGCGCTGCGACCTGTGGAGCCTGGGCGTCATCTTGTATATCCTACTCAGCGGCTA
CCCGCCCTTCGTGGGCCGCTGTGGCAGCGACTGCGGCTGGGACCGCGGCGAGGCCTGCCCTGCCTGCCAG
AACATGCTGTTTGAGAGCATCCAGGAGGGCAAGTACGAGTTCCCCGACAAGGACTGGGCCCACATCTCCT
GCGCTGCCAAAGACCTCATCTCCAAGCTGCTGGTCCGTGACGCCAAGCAGAGGCTGAGTGCCGCCCAAGT
CCTGCAGCACCCCTGGGTTCAGGGGTGCGCCCCGGAGAACACCTTGCCCACTCCCATGGTCCTGCAGAGG
AACAGCTGTGCCAAAGACCTCACGTCCTTCGCGGCTGAGGCCATTGCCATGAACCGGCAGCTGGCCCAGC
ACGACGAGGACCTGGCTGAGGAGGAGGCCGCGGGGCAGGGCCAGCCCGTCCTGGTCCGAGCTACCTCACG
CTGCCTGCAGCTGTCTCCACCCTCCCAGTCCAAGCTGGCGCAGCGGCGGCAAAGGGCCAGTCTGTCCTCG
GCCCCAGTGGTCCTGGTGGGAGACCACGCCTGACCCTCCCATCTCCCCTCTGTACATAGGTCACCCGTCC
CCCAATCAAATCTAAAGGTTTTTTAAGCTATCGCCAGCCGGTGTCCAGCGGGCTGCCCCTCCTCTGCCTG
GATTCCCAGGCACTAAGCTCAGCTGAGGGGGTGTTTTATAGAAGGTTTTTGCTTTTGGGTTTTTTTTT
CCTGTTTCCACCCCTCCCCGTTATTTTTTCCTTTGGATGGTTAAAAGCATTGCAGGCACCCGGGAAGGTG
AGCAGAGGGTAGGTGGGTGGGCTTGTCCCCTCCCCGGTCCCCGCCCTGCTCACCTCTACTATGAAGGTG
CCCCCAGGTCACCTGTGCTGCCCGCCATCTGCCCACGTGGCTTGCAGTGACTCAGGAGAGCAGGCCCACA
GCGTTTGCCATCTTGCAGAGCTGGGGAGGGGCACAGGACCCTGCCCTCGTGTTCCCTCCCAGCCCGCAGT
ATTTCAGGGACAGGCTCTTCCCCTCTATCCCTCACCCTGAGAGCACCCCTGGTGGCTTGGTTGGGGAAGG
GAGGGGCTGCCTGTCTCTGGAGGTGTCAGGCAGGCAGGTGGCAGGCAGCTCACCCACCCACCCCATGGGA
TCCCCCAGCCCTTCACCCGCGCCTGCCTTGTCCCCATGATAGTTGACAATCGGGGCTTCCTGCAAGGCCC
GTCTGTCTGTCCAGGACTCCTGGTGGCCAGATTCGGCCTCCGACCTTGACCTTAAACTGCAGCTGACCCC
AGGGGCTCGCCGCTGCCCCTCCCCTCCACACCAAGGCCTGAGACAGCAGGAGCCCCGCCTGGCCCGAAGC
CGTTTCCACCGCAGCAGGCAGAGGGGCTGGACAGGCACTGTCAGCCAATGTGGGGGTCCTGAAGACACC
CCCTTGGGGCACCCGAGTGCCCCTTCTCAGGGCTCAGTCTGACCGTAGCCACGTCCTGCCTCGCGCCGCC
CCTCGGGCCTGACCTGGAAGCTCCGTCAGCTCCGTCCTTGTCCTTAGAGCTGAGCCCAGACCCCGGGTC
TGGCCGAATCCTCACCCCCAGGGCAGTGTTTTGGTCTGCCACCTTCAGGAAAACGGCTGCGGCCTCGGC
CTCCCTTCGGGCACCCAGGAATGCGGGGGTCTGCTCAGTCCCCCACCCTCCATGCTCCAACCCCGGGG
GCTGCGGAGCCTGCTGCCCCTCCCCGCGGGTGGGACGTTCTATGCAATACAGGGTTCCACTTTAGAAG
TGCGCGCGGCTAGGGTCACCGCCCGCCCTTCCCGGCGCAGCCCCGAGCTCCACAGCTGGGGCAGCCCCT
CTGGCTTCTAAATCCGCGGTCGGGATTCTTCCTCCTGTTTAGTTTTTTAGTTTTTCCTTAAAAAAAAACA
ACACATCGATGGACTTTGCTTCCCTGTTCTTGAAGAATACTTGAATGTCGGGGGGCCTGGGGGTGGGGGC
```

Figure 20 (Continued)

```
CTCGGAGACCGTCTGCCTGGCCCTGCTGCCCCTCCTGAATCTCGTATGATGGTCACAGTCCGGTGGCCGT
GGGGGTGCTCTGCCTTCCCTGGTCCCCACTGCCCATATCTGTGGACTGCCCCTTCCAAAGACCCCTGGGG
GGGGTGGGGCATTCCGCCCACCCCTTTCCCCCATCACTTCTCGCCTGTCAGTGATTCCATGTTTCGTAAC
GGGGGATTCTCTGCCTTTTTGTATCAAAGAACAAGCAAATGGACCCCGCCCGCTGCAGGCGCCCATAGC
CATCGGGTCTCTAAAGCTGAGTGGCTAGCAGCGTTTGTTTGTTTGTTTTTTTTTTTTTTTCTGAAGGTGG
GACAGTCACTTCCTCCTCCCTCCCCACCCCTGTCGCATCCACGTGCGACCTGGAGGACTGGTCAGAACCG
TTACTGTGAATGAGTGAAGATCCTGGAGGACCCTGGGCCCCAGGCCAGCTCCCATCGCTGGGGGACGGTG
AACGGCCATGTGTTAATGTTACGATGTTTTTAAAAGACAAAAAAAAAAAAAAAACCTCAAAAGTTTTTTT
AAAGTGGGGAAAAACATCCAAGCACTTTAATTCCAATGTACCAGGTGAACTGACGGAGCTCAGAAGTTT
TCCTTTACACCAACTGTCAATGCCGGAATTTTGTATTCTGTTTTGTAAAGATTTAATAAAAGTCAAAAAA
CTTGCAAAAAAAAAAAAAAAAAAAA

>gi|42476084|ref|NM_201613.1| Homo sapiens IKBKB interacting protein (IKBIP),
transcript variant 3.1, mRNA
GTGAGGGGGCGCGGTCACCGCCCAGGGTTCCCACGAACGCCAAGGCGGCCACGTCCTGCTCCCCCTGGTG
AAGAAGCTGCCCTGGGCTTGTCGTCCTAGGGTCTCCAGACATGTCTGAGGTGAAGAGCCGGAAGAAGTCG
GGGCCCAAGGGAGCCCCTGCTGCGGAGCCCGGGAAGCGGAGCGAGGGCGGGAAGACCCCCGTGGCCCGGA
GCAGCGGAGGCGGGGCTGGGCAGACCCCCGAACGTGCCTGAGCCTGCTGTCGCTGGGGACGTGCCTGGG
CCTGGCCTGTGGCAGAAATCTGAAGCTATCATGGAACAATTGAAGTCTTTTCAAATAATTGCTCATCTAA
AGCGTCTACAGGAAGAAATTAATGAGGTAAAAACTTGGTCCAATAGGATAACTGAAAAACAGGATATACT
GAACAACAGTCTGACGACGCTTTCTCAAGACATTACAAAAGTAGACCAAAGTACAACTTCCATGGCAAAA
GATGTTGGTCTCAAGATTACAAGTGTAAAAACAGATATACGACGGATTTCAGGTTTAGTAACTGATGTAA
TATCATTGACAGATTCTGTGCAAGAACTAGAAAATAAAATAGAGAAAGTAGAAAAAAATACAGTAAAAAA
TATAGGTGATCTTCTTTCAAGCAGTATTGATCGAACAGCAACGCTCCGAAAGACAGCATCTGAAAATTCA
CAAAGAATTAACTCTGTTAAGAAGACGCTAACCGAACTAAAGAGTGACTTCGACAAACATACAGATAGAT
TTCTAAGCTTAGAAGGTGACAGAGCCAAAGTTCTGAAGACAGTGACTTTTGCAAATGATCTAAAACCAAA
GGTGTATAATCTAAAGAAGGACTTTTCCCGTTTAGAACCATTAGTAAATGATTTAACACTACGCATTGGG
AGATTGGTTACCGACTTACTACAAAGAGAGAAAGAAATTGCTTTCTTAAGTGAAAAAATATCTAATTTAA
CAATAGTCCAAGCTGAGATTAAGGATATTAAAGATGAAATAGCACACATTTCAGATATGAATTAGTTTGA
CATTATTGAGATTAGACTAAGGTAATTTTTTTAATGGGACCTCTCATGAGAAGACTGGTAAATCAAAAAT
AATGATATTTTGGAGCAAAAGTCATTTTATATTTAATCCTATTTTGTACAGTAAAAATAAAACTTTAAAA
CAGGTTGATTTTCCAAAATAAATATGCTAAAACCTAAAAAAAAAAAAAAAAAAAAA >gi|45827738|ref|NM_206824.1| Homo sapiens vitamin K epoxide reductase complex,
subunit 1 (VKORC1), transcript variant 2, mRNA
CGATTCCGCACGTCCCTTACCCGCTTCACTAGTCCCGGCATTCTTCGCTGTTTTCCTAACTCGCCCGCTT
GACTAGCGCCCTGGAACAGCCATTTGGGTCGTGGAGTGCGAGCACGGCCGGCCAATCGCCGAGTCAGAGG
GCCAGGAGGGGCGCGGCCATTCGCCGCCCGGCCCCTGCTCCGTGGCTGGTTTTCTCCGCGGGCGCCTCGG
GCGGAACCTGGAGATAATGGGCAGCACCTGGGGGAGCCCTGGCTGGGTGCGGCTCGCTCTTTGCCTGACG
GGCTTAGTGCTCTCGCTCTACGCGCTGCACGTGAAGGCGGCGCGCGCCCGGGACCGGGATTACCGCGCGC
TCTGCGACGTGGGCACCGCCATCAGCTGTTCGCGCGTCTTCTCCTCCAGGTTGCCTGCGGACACGCTGGG
CCTCTGTCCTGATGCTGCTGAGCTCCCTGGTGTCTCTCGCTGGTTCTGTCTACCTGGCCTGGATCCTGTT
```

Figure 20 (Continued)

CTTCGTGCTCTATGATTTCTGCATTGTTTGTATCACCACCTATGCTATCAACGTGAGCCTGATGTGGCTC
AGTTTCCGGAAGGTCCAAGAACCCCAGGGCAAGGCTAAGAGGCACTGAGCCCTCAACCCAAGCCAGGCTG
ACCTCATCTGCTTTGCTTTGGCATGTGAGCCTTGCCTAAGGGGGCATATCTGGGTCCCTAGAAGGCCCTA
GATGTGGGGCTTCTAGATTACCCCCTCCTCCTGCCATACCCGCACATGACAATGGACCAAATGTGCCACA
CGCTCGCTCTTTTTTACACCCAGTGCCTCTGACTCTGTCCCCATGGGCTGGTCTCCAAAGCTCTTTCCAT
TGCCCAGGGAGGGAAGGTTCTGAGCAATAAAGTTTCTTAGATCAATCAAAAAAAAAAAAAAAAAAAAA

>gi|117606358|ref|NM_206909.2| Homo sapiens pleckstrin and Sec7 domain containing
3 (PSD3), transcript variant 2, mRNA
AGGTTCTTGGAAGGCTGTGAGGCTCGGCAGTCACTGAACTTGGGAGCTGAAGAATACTGGACGGGGCTTC
GGAGAGGAAGGATGGTCCAGGCGCACCCCAGGGGTTGCGATGGGCTCTTCTTGGTGTCTGTATGGTTGCT
GCAATGCTGGGGTGAAAACAACACGGCTAGAAGCTCATTCTGAAATGGGGAGCACTGAAATTTTGGAAAA
GGAGACCCCAGAAAATCTCAGTAATGGTACCAGCAGCAATGTGGAAGCAGCCAAAAGGTTGGCCAAACGC
CTTTATCAGCTGGACAGATTCAAAAGATCAGATGTTGCAAAACACCTTGGCAAGAACAACGAATTTAGCA
AACTAGTTGCAGAAGAATATCTGAAGTTTTTTGATTTTACAGGAATGACGCTGGATCAGTCACTCAGGTA
TTTCTTTAAAGCATTCTCTCTTGTGGGAGAAACTCAAGAACGAGAGAGAGTTTTAATACACTTCTCCAAT
AGATATTTTTATTGTAACCCAGATACCATTGCTTCACAAGATGGAGTCCATTGCCTTACCTGTGCAATAA
TGCTTCTTAATACCGATCTACATGGCCACAATATTGGAAAGAAGATGACCTGTCAGGAGTTCATTGCAAA
TCTGCAAGGGGTAAATGAGGGTGTTGATTTCTCCAAGGATCTGCTGAAAGCTCTGTACAACTCAATCAAG
AATGAGAAGCTTGAATGGGCAGTAGATGATGAAGAGAAAAAAAGTCTCCCTCAGAAAGTACTGAGGAGA
AAGCTAACGGAACACATCCAAAGACCATCAGTCGTATTGGAAGTACTACTAACCCATTTTTGGACATTCC
TCATGATCCAAATGCTGCTGTGTACAAAAGTGGATTCTTGGCTCGGAAAATTCATGCAGATATGGATGGA
AAGAAGACTCCAAGAGGAAAACGAGGATGGAAAACCTTTTATGCTGTACTGAAGGGAACAGTTCTTTACT
TGCAAAAGGATGAATACAAGCCAGAAAAGGCCTTGTCTGAAGAGGACTTGAAAAACGCTGTGAGTGTGCA
CCACGCATTGGCATCCAAGGCCACGGACTATGAGAAGAAACCAAACGTGTTTAAACTTAAAACTGCCGAC
TGGAGGGTCTTGCTTTTTCAAACTCAGAGCCCAGAGGAAATGCAAGGGTGGATAAACAAAATCAATTGTG
TGGCAGCTGTATTTTCTGCACCACCATTTCCAGCAGCAATCGGCTCTCAGAAGAAGTTTAGCCGCCCACT
TCTGCCTGCCACTACAACAAAACTGTCTCAGGAGGAGCAACTGAAGTCACATGAAAGTAAGCTGAAGCAG
ATCACCACCGAGCTGGCCGAGCACCGCTCATATCCCCCCGACAAGAAGGTCAAAGCCAAGGACGTCGATG
AGTACAAACTGAAAGACCACTATCTGGAGTTTGAGAAAACCCGCTATGAAATGTATGTCAGCATTCTCAA
GGAAGGAGGCAAAGAGCTACTGAGTAACGATGAAAGCGAGGCTGCAGGACTGAAGAAGTCGCACTCGAGT
CCTTCGCTGAACCCGGATACTTCTCCAATCACTGCCAAAGTCAAGCGTAACGTGTCAGAGAGGAAGGATC
ACCGACCTGAAACACCAAGCATTAAGCAAAAAGTTACTTAGAGTCCATCTGCGGCCAGGAAGTGCTGGTC
ATGGAGCAAAATAGGGTTTTTCAAGATCTTTCTGGTAATCCGTGAATATATTTAAAAAAAAAAAGTCTGT
GACAAAACGGTGCATTAGTAATTTTTTCTATTGTATATTTTTGTTAGTTTCTGTACAGATTGTCTTTGCT
CTTGATTTCTTTTGCTTTGATGATTTTTGCAACTTGATAGCTAATGCACCTTTTCTGTGAGGAGGAGGGG
ATCGTGATTTCAGAATGAATTATGTATCCCTTCTCTTTGGTTTTCTCTTGTTTGCAGTCTGCTCAGTTG
TTTTATGTATTCTCATATCAACTGTTAAACTTTTTTTAAGGTTAAAGAATTTAATCCATTGTGAAACAC
TTAACTGGACAAACTGTAGTTTTAGTAAATTCTAGCTGGAGTTAATATACGCCTTTATATGTGAAATCTT
GCCCAGTCACAGAGGTAGAATTGAGCACTCACAGATGCTCCAGTAAGAATCACAGTGCTGGGAATCTAGT
TGCTCCAATATGAGGCAGCTTCATGTGCAGCTTAGCACTTGTTGTTGAGATCGGACCCTGCTGGAAGCAG
GGAAAAGAAGCGTGAAGATCGTAGGATTGAGAACTTAGGGAAGCACATTAGCTTGCTTGAAGTGCTGATT Figure 20 (Continued)

```
CCATTTCAGCCAAGCAAGGGAAAGAGGAAGTGGAGTCATTTTGCCTTTGAAGGCTGAGGAAAGATTGATA
CCCAGTTAATTTTGTTTGCTAAAGGATGGGGGCAATAATCGGCCCTTGAGGAGCTGCAGCAGTAGGCATG
TGCTCAGTCTGCAGGAATTGTTACCTCACTCCCACAGGGTCTAGACTAGAAATCCATCATCTCTATCGTT
GATATCCTTCCATCCAGGAATAGATTTTTCTTACTCTACATATGTGTGTGCGTGCGTGTGTGCGTG
TGTGGGCATGGGGTTGTGTCCTGGTTGTGATATTGAGGTCTTCCTTCCTAACAAATTAATACTAAAATGA
AACAGCTTTTCTTGTGTCCTTAAGACAAAATAAGGAAGGAAAACGTAGCTGCAGTTGTCCACGATGGATA
TTGGTTCTTTAAAATATATCTGAAAGTAGTAGTCAGAATGAATTATGGTTGGAAAACTGAGGAATCTTCT
GGTTGCAGGTGCAAAGTGACTTTGTTTATTCTTGTCTCAGTCTCCTTGATAGCCACTTCACTCTGCTACT
ACTCAACTTTCTCCTAAAAATACTTCATCTATTTTCAGTCCTTTCTTTCTGTCTACTCAAAATGGTTCTA
TTAACTTTGCAGTCATGAGCTTGTTCCAGTTACAGTCCCTTTGAAGTTCAGGGTGATAAACAGAATATTC
TTCTGTAGAGGAAGAGAAAGGAGTGAAAGTTTAGCCCACTGAGACCTAGAGCTTTGTGATTTCCTAACCT
TGAAACTCTGTAATCCCTAAAGTTAAAATCTCCGCAAGTGGCACAACTTCAGAACTAATAGTATCACTTT
GATTTTTCTTTTTCCTCCCTTAGAAAGTTTCTCTAGTTCTATAGTTTATTTGTTGAAGGTACTATGACCA
AAGAATCAGCTGCTCTACAGGAATAGCATGGTTCCAGTGAATTAGAGAAAACCTGCTGTAAAGCCATGGT
AGTGTCTAAGTGGTATGTTATTATGATGTACTAGCATTTATTTACAGAATTATTTATTAACGTTTACTTC
CTTCCCCTCTGTAAATGTCCATGACTATTGCCCAGAGAAGGCTTACCCCTCTCTAGGGTTGCAGTTGCTT
TCTTTGTAATAAGTATTTTGCCACACCTGTAAAAAAAAAAACCTCACTTTTAACTCTCTGCCTTGTTTGG
GTAAAGGCAGTAACTAAGTTTATGTTTCAGAACTGCAAAACAAACAGGATAGTTACCAATATGGCCCATG
TATCAGATTGATTTTTGTAGCCTCTCACTGAATCCAACATATCCACAAGCAAGTTATCTGTCTTTCTACC
TGATAATCTAAATTATCAGGATATTTGTTTTCTGCCTAAATGTTTATACTAAGCCGAGGGGAGAGAGGTA
CCTAGACCATGTCATCTACAAGCTTCAGTAACTAAAGAAAAAGGAACTTCCCTGAGTGGCTTGAATGTGT
TTGCCCACAGTCTATATCTATGTATATAGAATGTCTGTATGTATTTTACTTATTTAATATACATTGAATG
GTACCTTGCTACAGTATTTCTGACATTTAGAGTAGTGTTGAAATACTCGGCTAGCATCAGCACCACTATA
GCACTGTCCGTGTCATATGAGTCACTAATATTAACTCCAGGGACTTCTGGATAGGCTAATAGATCATTGG
ATACGAAGGGCTCTTTTGAAGCTTCAGTATACCATGTTTGCATAGTTTATCTTTAAAAACAACTTTAAAG
GTTCTTTTGTGAGCCAGGATCTCAGACTGCCGTAGCATGATGCTGTCCATCTTTAGCGCATGGGCTGAGA
ACACCTCTTCCCTGAGGCTTCTGAAGGTTGCTGTCTGTCATGAGTGCATGAAGGAGGCCAAGAGTTTATG
CTATGGGAGGAAACAGTCACTGATTTGCCTAGATTCTGAGAGTCTGGCCCATAGCCAACCACATTTTCCT
TTGGGATAATTTATTTCCTGTGGCATCTAGCCAGAAGAAATTGAGGATGTTTCCTTTCACAGCTGCTCCA
AGCCTGTTGCCCAATTCACGGTACAAGGGAGCACCCCTTCCCTTTCCTCTGAAGGTACGCCACCCACCTC
CGTCGCCCACCTCAGCGCCCAGGAGCCTTGGGACTTCCTTCCATATGATAAATCATTCTTCTTCACGTCA
ATACACTTCATATTAATTTCTAGTACAGAAAATCTTGACAGCTATCAGAATGCCTTGGTCATAGTGTTGT
TGCAAAATTGACCATACAGGTGGCCCATGTATAAAATCTGAATTTTAGGGGTTTGTCCCCACCTCGCATG
CTGGCTTTTACAGGGAGGTGTCTGGGATTCCTCATTAGCAATCAAAACTTAATTACTGGGATGCAGAGTC
CTTACTTTATCGCCAGCCCGTAGGCATTTCTGAAGTGCACTTTTTTGAAACATCATTTTGCTAACTCTCA
GCAGTGTCTAATTAAACTGAGCAATACTTTTGTGAATTTTAATTAATCTCAGCAAAACCATGATGGGAGA
GAGTCCTCTGATGGAAATGTAGTCCCTGGATTATGTGTAACCTTTTTATTCCTCTTAGATGCAGAGGATA
GAAAGCATTTTTGGTGCAGTGGTCTTGTGGCAAACACAAGACCCTCTATGCGTCTCCAACTGTTATCCT
AATCTAGAAAATGAGGACTGGCCCCTGGGCAAAAGTGACATGAGGAATTTACTCTGGAAGAGGAAAATCT
GGGTGGCTTTCCAAGGCTAAGATAGGTTTGTATTTCACCCTGTGGCCAAGCTACAGAACTTCTGAGATTG
TGGAAGAATTTTTGCAACCAGCAGGGAAAGAGGCCTCTTACTGCCTAAACACAAAGTTACACTGAGCTTT
TCTACTGTCCTTTGCCTATTGCTCCCTCTATCATGTAAAGATCTGGGAAGGATGAGAGGCAGGGCCTGCT
```

Figure 20 (Continued)

```
TGTCATGAGCTGCACTCTTTTCTTTTTAACTAATCATTGACAATTGGAAGAAAATTGACGTTAAAGAAGT
TTCTCCATTGTCTTACTAACAAAACCTTTTGGGTTTCATTAATTGTCCTTGAAATTGAGTTCCTTTGGCA
TTTTTCCTTGCAGTCATCAGTTAAGCATGTTGCATCCTGAATTCACAGAAGTTTAGCTTTGCAGGTTTGA
ATCTCTGTAATTTAACTCCCGTGGACTTGGTCGAGTTTTCAGCAGGTTGGGAGCCACCTCTCTTCATTTC
AGCAGTGAGTCATCCCTTGACTTTTCAAATGACAGAATTTTTTCCAATTGTAAAATTAGCACTGTAAAAC
AAAGAACCAAAGTGGCATCCTAAGAGTTGTTAAACCTGAAGTCTAGTTTATGAGGAATTGTCCAAGTTGG
AGTTTAAATAGTATCTGCTTTTGTCTCAAAGCATCTAAGTTATTCTGACAGAAAATGGTAAGTCAGCTTT
GCAGGCAGATGCGCCTCTGGGCCTCCTACCTTGCTCCACAGCTTTCTGGCCATCTTGTCTCCCAGGCCAT
GCCACTGCTCTGCCACATGTCAGCAAATTTCTTTCCACCAGTCTTATAGCATCTTACATGATCAAATCAT
CACAGAATAACCCCGTGATAGATTATTGATAGCAATAGAGAGGGGCTTTGTCACTGATTTTCTCTCAGA
TTCCTTTTCCATCTCTCATCCATAAAGGAAGGACTGAAATCCAAAGGCATTCTCCTTTTGTACCTACAGT
ATCCAGAACCCACGTGGGCAGCCTTCTGCTTATGACAATAATTGGCCCATTGCATGCAGAGAGAATGTCT
TCATAGAGAGAATGTCATTAAATACTTGAATCTGCATGACAGTTTGACTTGAATGCAACAGCAGGAAAAT
TTTGCAAGTTACATAATTGTATATACAGTAGGTTTTCTTAAGTCTCTTCGGTTCATCCTTTGTAATTTGT
GTGTGTATCTGTAGTATTGCAGGCTTTTGGAGACTATTCTTACAGGCAGTATGTCAGTCATCAAAGAAAA
TGCTGTCACCTGCCATTGTTGTATTTGTGGGTATTTATAGTTGTATGTATGTAAATGCATCAGTGTGTAG
ATTGCATATCAGTGTATGGTACATGTACATCAAAATTATTTTTGTCCTTAATCAGTGTGATATGAAAAGC
AAGTACAACCTCATAGGACTGATTATATAATGAAGTTGTTGAGAGTATATATAGTGGTATTGTTTTATTA
AACTTAAACTCAAATAATATTTTGATTAAAATTTTTAATAAGACTTTATGCTAGAAAATTCTTTGAGCTT
TGAATCACCAGGGCAAAAATGACTTTCAACTAACCTTGTGAATCTTTTGCAGTGTACTGTGTGCAATACC
AAGGGCATAGCTCCCTGTAATTTGGGAAATACAGAAAGAAAAGAAAAAAAAAAAAAAAGGCAGCCTGTGC
AGTCTTAGTAACTTTAGTATTAAGAGCACTTAAAGTCAAACTGACAATTTTGGGCTTATTACAAAATGTG
ATGCTTTAAAGCACACGTTCTTTATTGTTGTTGTAATTAGTCCATAAAAAATATAGCTTTCGGAAGAATT
AAGTACCCACCATATCATTTATGTATTTGTGTATGTTTTACGGGAGATCAAACCACTCTCGTGGTGCCGC
ATCCGTACTCGCTTGACTTGGAAGAAATATCACAAGCACTAAAGTATATCAGGGCATCCCAGGATTGGGT
ACTGTATCCTAGGTTTGCAGTTGCAGAAATTAGCATCTAGTGTCACAGGTAAAAGAATTTCAGGACCAGG
TTTAAACTTTATTTTAAATATTTTTATACTTAGGTCTCTTTTTCCTGCCTCTCCCCAAAGAAGAGCCACT
GGCCTTAGTTGTTTGAGCTTACTGCTTATATTATAGAGTGTAAATAGGTAACTAGAGACTAAAATTTTAT
TAACCAGCATGTTTGGTATATTTAAAGCAGTGACTGAGTGTGTTTGAGTGAGTGGCTGAGTGCAGTGTCT
TTTGTTTAAACACACTGCCTCGTGTCTTTGTAGCTGATTCAGAGAGTTTGAATTGTGGGTGGGAGACTA
ACTTCAGCTCCAGGCTGCAGTAATGTGTTGGTAGTTACACTTGAGGCATTTTTTTGTTGTTGTTAATTAA
CTCTATAGTCTCAAACTATTTTTGCAAATATATCATTTTTCCTAATTGGTTCTTGACGTGCAGTGGACTG
GCTCTGTGAATGATTGGCAGGGTCTTAGTTTTGCGAGAGTATTTCCTTCTAAGAATTATTGTGATCTGCA
GAAACAGCCATTTGATTCAAAAATCATGTAGAAAAGGAGTAGGAGAAGCAAAACGTTTCATTTTTGGGCC
TTAACCATTTGAAATGTTTGGACTTTAAACATAAAGCCATGGAGTTTATAAAGCCAAGTAACCATTTGAT
ATGGATAATAATATCTACTCTAGAGAGTATATATATGCACATTGATTTTAATGCTGTTAAGATACTT
TTGTAAAACTGTAGGAACAAGAGTAATTAGACCAAATTGAAGCTTAGGGGACAGTAAAGTGGTTGCTTTC
CATTTAGGGTAACCATGCATGTGGTTAGTCCTCTCCTCCTGAGATTCAGAACCAGTTGACTGTCCCCTTA
GGTGTATAAGGAGAAAAGTTGACATGTCTGGGACCTCTGACATGTGTACACATGCTTGCACACATGCACA
CACAGTGAATGTTTTAAGTTATACAAACATAAGACCTTAAGATGCAAAGAGCCAGAATATTCTAAAGAGG
TGATGAACAGAGGGGGTGGAAACTGCATCACAGATGTTTTCCAAGGGCCAGGGTGGAATCTGAGCTCTAG
TGTCTGACTTTGAGATGCATTATATTTTTAACACATAAATGAGGGGATCCATATCACATTCTTTCTTGTG
```

Figure 20 (Continued)

```
GACCACCAAATTGAAGGCTTTCTTGTAATTCACAAGCAGCAGCTCTCCAGCATCTCTCCGTAGCCTGGGT
GAAGTCCCAGAAGCTGGTGTGCATCATTTTCCAAGGTGGCAGAGCTGCTTGCTCTGCAGATCATTCCTTT
GAGAGAGGAGTACAAGTGAAGAAACAAGGAGGCACTTCCTGTAGGAGCACTGATGTGCCTTGTCCACACT
CCCCTCTGAGCTTTACTGGTAAGAGAGCTCCGACTGAACATGCTGAGCAGTTGAGCACTTTTCCATCAGC
AACAACAGCGAGGATGGAAATGGAAAGGAACCGAACTAAAATGCATTTCCCTTTGCAGGGCAGAGAGCTA
AGCTCTTAGGAATAGTGTTATAGAAATAAGCACCCTAACTTCAATTCCTGAAAATGTTGGTTAATGGAGA
GAATTTTGGAGTTTCACTTAATATTTTCCCATCGGTCGCCATAAATAAGTCTTCAGGCGCTCCTAGAAGA
GTCCCAGCCCAAGGCTCGATTAAGGACCACACTGCAGGTCTGAGGCTCACTGCTCTGAGTCCTGAACACC
AGAGCCCTGCAGAGAGTGGTGATAACACATCATCTCTGCAAAGAGGAACCTCTCCCCCGGCCGCCACTTC
ACTCAGGCTTCTACTGAGCAGCAAGGACAGCCTGGGTTTCAAATGCCACTTCCCCTGCTTTAGGGATCCA
GGTGTCCTGATAGCGTGACCCTGCTGAGGCAAGGTATCAACTCCGAGAGTGACTGAGTCACTGAGCGTGG
CACATGAACAAACGTCATGACAAAGATTCTCTGAGTGAAGTTAACACCACGTATTTTACCTTTGCAAAAA
ACAAACTGGCACCCTGAGTTCTAACTACGGACGGACGATATCTTTGCCTCCACACCCAGATTCCTGGAAA
TGGCTAACGTTTCCTTTCTAGGGGAAGGGTCGAGGAATACTCAAGTGCTAGCTTAGCAGCTTTGTTCAGT
CCAGATCAGAGCTGTTAGGTAAAGGCCTAACCACCTCCCTGCAGTCTCTTATATCTCAAGCTTTAGGAAC
CCATTTCTAAATGTACACTAGCGGAGAATTTATATTGTCAGCCTTGATTACCATAGGACAGGCAGAAAGG
CGATAATTTGTATCTTTTAATATAAAAGAAGCTTTTAACTTTTCCAGCCTATTATAATAACTGAGTTATA
TTCACTGTGGCTCAAACTAATTGGCATTGTGGAACATTTCTTTACCTTCAAAGTTTTCTCCACCAATCAT
TTCAGTTCTATTGCAGTCCTGGTGCCATATGTCCCCTGCAAATTGTGAAAGTAATTAGTGACAAAATAGC
AGCCTGCTCCTTTTCAATGGCGAAACTGTCGGCATTAGCAGTTTTGGGTAAGCTGGCGGTACTATAACAC
GTACTGGAAACCTGTTCCTCATCACCACCTACCAGATTCTGGAAATGCCGTCTTCTAGAAAACGATGGCG
TTTGTGGTGGTCTTCTTTTGAAAGGAACAGTAATTTGTGTGGATATTGTTAAAGTGTTTAAAGAATATTT
TGACAATTAAGTTTACATTTTACAATTGCTTTATTTTTTATTAAAATAGTTGTATATAAATATTACCCTA
TTTCACTGTTGTTCAAGTAAATCTAAACCTTGTAGACAAGTGAGTCATCTGATATGTATAGAAGCTGTGA
TATATAGAGTACATTTATTGTGTAAATGTTTATGAATATAATTGTTCCTGTGTTTTTATAAGTTGGGGAT
ATTTTGTTGTTTTACGGCAACAAAATTTATTGCATTTAAATGGTTTTTATGTAATAGAAATCACGCAAAA
TAGTGAAGGATTTAAAATATGTATATGATACATGTAAATGTACAAACTTTAGAAAGAAATAAATCCAACA
AATTTCAATCA

>gi|46389559|ref|NM_207047.1| Homo sapiens endosulfine alpha (ENSA), transcript
variant 7, mRNA
GGTTGGAAAGACGGTGAATGGAAAGGGGATGGCTGGTGGTCTTGGGTGTGATGTGTGTTATTGGTTTGTA
GAGGACACGCAGGAGAAAGAAGGTATTCTGCCTGAGAGAGCTGAAGAGGCAAAGCTAAAGGCCAAATACC
CAAGCCTAGGACAAAAGCCTGGAGGCTCCGACTTCCTCATGAAGAGACTCCAGAAAGGGCAAAAGTACTT
TGACTCAGGAGACTACAACATGGCCAAAGCCAAGATGAAGAATAAGCAGCTGCCAAGTGCAGGACCAGAC
AAGAACCTGGTGACTGGTGATCACATCCCCACCCCACAGGATCTGCCCCAGAGAAAGTCCTCGCTCGTCA
CCAGCAAGCTTGCGGGGTAACCTGAGCCCCCCTCTCCTCCCCTTCCTCAACCACTGGACGTTTATATATT
ATAGGCAGGGATGAAATGGGCACCTAGTCAGATCTTCTCAGCTTGCTAGCCAGAAATGACTGTGATTCTG
CTGGGGGCTGCTGAGAAGGTAATGTAGGTTGAAAAGGGGCTCTAAGTTTATTTATTTCGTTAGATTGACA
CTTCCACACACTCCCTGTAGTCCAGGTAGGGCCCAGAAATAGGAAAGGCTAGGATTGGATAATGCTGCAA
ATGCTTTTTTGTGTGAGAAACTGGAGAGATGTGATTCTCCTTTTGGGAGAGAATGTCCCAAAATTGAT
TAGGCTGAGCCTTGGGAATAGTTTGGCAGGTTTAACATCCCAAGGCTAACCTAACGTAGTTGGGAAAGGT
```

Figure 20 (Continued)

```
AGATTGAATGAGACATGTTTTCTGTGCTTCTAAGTGTTCTGTCCCTTAGGCTGCTATTGCTTCATGTTTC
CATTATGGCAGGTTTAGAGAATCCTTAAAAAGAAAAATTGACTTGCTTGCCTAAAACTACAGTGCCCCCT
TAGCCTCCATTACTTAGTATCTCTTACAGTTTGCTCTGGCTCTCAAATAATATAAAGATTGATGAACATT
ATTCACAGAAAATGGGCACCTTCTCTCTCTCTTCCAGCATGTTGCTTTTGAAAGTATCATGGGATAGTGG
GACGAGCACTGGTTTAGGAGTCAAGATATCTGGGTTCTCACTCTACTCAGTCCCAGCAGAGCTGTTGTAT
AACCTTGATTAAGTCATTTAGCCTCTCTGGATTTCTATTTCCTCATCTGTAAAATAGAGTTAAATGTATG
TAAGATTGATTCTGATTCTGAAGTCTTAACTGCCAGCAGAAAAACTCCATACTGTTCATTGTAAAACTAA
AAGTGAGGAAGGCTCGTGGGTGGTGAACCTCTGCTCTGTAATACTGGGAAAGTACTACAGAGGGGAACCA
TTTGAGGGATACATGAGGAGAGAGTAAATTGAGGTTTGGGGATTATAAATTCAGGCAAGAGAACCTTATA
GATATCACAGTCTTGAGGGTCAAAAAAAAATACTTAGGAAGCTAGCCATGGAAGCTTCTTGCCTCTGACC
CAGCCCACTTTCCCAGCCTACCTCTGGGCCTTAGCTGCTAAAAAGCTTCTCTGGCAGCGGAGCTGCAGGC
CTGAGGAAACATGCTCAGTCATGCACATGTGTTGACCCATGTTTCAGATGCAGTCTGATGCCAGGTATAT
TGTTAGGGAAAGAGGAAGAAGGGTAAACTGAGCTAGCCCCTGGGGCTGAGTACTCCTGCAGGGCTGGAGG
AACAGGTTCTTAGAAGATGATTCACCTTGGAGGAAGCTGGGAAAGTGGTTAGGGAGGGAGAGGAGGAAG
ACTGAGAAATCTCTGCATCCCCAGAACTCAGCAACCCAGCTCTTTTATCATGAGGAGAGGTAGCCATGCT
GACTCATGAACAGGTGGAGGAAAGGGGTTGCAGGTGACCAGCATCTTCAATCTAGTTACCACCAGCTTGG
CTAGAATTTTATTGAACGCAACTTGCTAGTTATGACAGAGAGGACCAGGGTGAGAACTAATGCTCAAGAG
AGCAAGATTCTGTAATCCTCTTGCCCTCTCACATCACAAATTCTGATATGCCAAACATTTGGCCCAATGA
GAATGACTGATAGACTTGCTGATGTGCATGTGGGGGATGAGGTGTGTATATGCCTTTCTCCTGACTGGC
CATTCAGTGTTCAGGCTGTCATTCAAATTGGATAGGAGAAAGTTGGTGAGGAAGGAATGGAGAGAGCAGG
ATCCCTGGACTCCCTGGTCCCCAAACTCCTTGACTGTCACTTGTAATTGTATATAATTTTTGTGTTTCTT
GCTCCATTTCCTCATGCTGTCATCCTTAAAGTCCATCTGGGAAGGGGAAAATGCTGAACACCATTGTATA
GTTTCTTCAACTGTCCCAGCCATGTTGTACATAGATATGTCATGTTATTATATATATAAATATATATATA
ATTTTGTACGTTTTCTTCATCTCCGATCTTCTCAAATTCTGTACTTTTTTTCTTTTCTGTCTGAGCTGCC
TTCTCTATCATTCAGCTTGAGTCCTCAAGACTACTGGTCACAATGAGTCTGATTTTTAGGAAGGAATAGG
AGGAGCAGGGAAATCAGAAAAACTGTTGGTCTCACTCTGTCTCTCTACCTGGTCATCTTCAAGGCTAAGA
AAACAAACAAGCTACATTCTGTATTTGCCAGTTTCCACAGCATGAAGTACATAGCTTCCTTAGCAAGGAG
TGGTCATTCCAAAATCCAAATGCAAATTGCTTTGATTAAACCTAGATTATTAAATCCATTCAGAACAGCA
AAAAAAAAAAAAAAAAA

>gi|310119073|ref|XM_209489.7| PREDICTED: Homo sapiens hypothetical protein
LOC285141 (LOC285141), mRNA
GAGTCAGTCTACAGGCTAGGTGCACACTGGACAGTCAGGGTGGTTGTGAGCTGATGGAGACTGTAAATGA
ACCAGAAACAGGTGAAGTGAGCAAAGATGCAGTCATTGTAAAGCAGGAGAAAAATAATGAATATTGCCTT
CAGGATATTGATGATAAATTGTCAGAATCAGCAGAGGATGATGGTGAAGATGATACCAATGATGAAGATG
ATGATGAAGATAGTAACCCTAAAAAGAATACTCAGGCCCCACTAGAGTTAATGGCAGAATTTCTGAGAGC
AGAAATGGCCCGAGAGTACCAGCTGGCAAAAAAATTATGTCAGATGATCCTAATCTATGAACCAGAAAAT
CCTGAGGCCAAGGAGTTTTTCACACTTATTGAAGAAATGTTGCTGATGGAGAAAACTCAGAATCATGAGC
AAGACGGTGAAAACAGTGATGAAGACAGCAGTGGTGAGAGTAAAGGAGAAAGCGATGAGGAGCTGAGTGA
CGAGAGCTCTGACGAAGGTGAAGATGGATCATGAGTGTTGCTGCAATACTTGAAGCTTCATGTATTTTCA
TTAATGTATACCATGCAAATATAAAGACAAGTGACATTTTA
```

Figure 20 (Continued)

>gi|38197112|gb|BC000306.2| Homo sapiens hydroxyacyl-Coenzyme A dehydrogenase, mRNA (cDNA clone MGC:8392 IMAGE:2820507), complete cds
CCTCGCTGTCGCCGCCGCTGCCACACCATGGCCTTCGTCACCAGGCAGTTCATGCGTTCCGTGTCCTCCT
CGTCCACCGCCTCGGCCTCGGCCAAGAAGATAATCGTCAAGCACGTGACGGTCATCGGCGGCGGGCTGAT
GGGCGCCGGCATTGCCCAGGTTGCTGCAGCAACTGGTCACACAGTAGTGTTGGTAGACCAGACAGAGGAC
ATCCTGGCAAAATCCAAAAAGGGAATTGAGGAAAGCCTTAGGAAAGTGGCAAAGAAGAAGTTTGCAGAAA
ACCCTAAGGCCGGCGATGAATTTGTGGAGAAGACCCTGAGCACCATAGCGACCAGCACGGATGCAGCCTC
CGTTGTCCACAGCACAGACTTGGTGGTGGAAGCCATCGTGGAGAATCTGAAGGTGAAAAACGAGCTCTTC
AAAAGGCTGGACAAGTTTGCTGCTGAACATACAATCTTTGCCAGCAACACTTCCTCCTTGCAGATTACAA
GCATAGCTAATGCCACCACCAGACAAGACCGATTCGCTGGCCTCCATTTCTTCAACCCAGTGCCTGTCAT
GAAACTTGTGGAGGTCATTAAAACACCAATGACCAGCCAGAAGACATTTGAATCTTTGGTAGACTTTAGC
AAAGCCCTAGGAAAGCATCCTGTTTCTTGCAAGGACACTCCTGGGTTTATTGTGAACCGCCTCCTGGTTC
CATACCTCATGGAAGCAATCAGGCTGTATGAACGAGGTGACGCATCCAAAGAAGACATTGACACTGCTAT
GAAATTAGGAGCCGGTTACCCCATGGGCCCATTTGAGCTTCTAGATTATGTCGGACTGGATACTACGAAG
TTCATCGTGGATGGGTGGCATGAAATGGATGCAGAGAACCCATTACATCAGCCCAGCCCATCCTTAAATA
AGCTGGTAGCAGAGAACAAGTTCGGCAAGAAGACTGGAGAAGGATTTTACAAATACAAGTGATGTGCAGC
TTCTCCGGCTCTGAGAAGAACACCTGAGAGCGCTTTCCAGCCAGTGCCCGAGTGCCTGTGGGAATGCTC
TTTGGTCAGACATTCCCTCACACAGTACAGATTAATAAATGTGCATTTTGATTGTAAAAAAAAAAAAAAA
AAAAA >gi|33875619|gb|BC000594.2| Homo sapiens lysyl oxidase-like 2, mRNA (cDNA clone MGC:1709 IMAGE:3347512), complete cds
CTCCAGCCATCGGAGACCAGAGCCGCCCCCTCTGCTCGAGAAAGGGGCTCAGCGGCGGCGGAAGCGGAGG
GGGACCACCGTGGAGAGCGCGGTCCCAGCCCGGCCACTGCGGATCCCTGAAACCAAAAAGCTCCTGCTGC
TTCTGTACCCCGCCTGTCCCTCCCAGCTGCGCAGGGCCCCTTCGTGGGATCATCAGCCCGAAGACAGGGA
TGGAGAGGCCTCTGTGCTCCCACCTCTGCAGCTGCCTGGCTATGCTGGCCCTCCTGTCCCCCCTGAGCCT
GGCACAGTATGACAGCTGGCCCCATTACCCCGAGTACTTCCAGCAACCGGCTCCTGAGTATCACCAGCCC
CAGGCCCCCGCCAACGTGGCCAAGATTCAGCTGCGCCTGGCTGGGCAGAAGAGGAAGCACAGCGAGGGCC
GGGTGGAGGTGTACTATGATGGCCAGTGGGGCACCGTGTGCGATGACGACTTCTCCATCCACGCTGCCCA
CGTCGTCTGCCGGGAGCTGGGCTACGTGGAGGCCAAGTCCTGGACTGCCAGCTCCTCCTACGGCAAGGGA
GAAGGGCCCATCTGGTTAGACAATCTCCACTGTACTGGCAACGAGGCGACCCTTGCAGCATGCACCTCCA
ATGGCTGGGGCGTCACTGACTGCAAGCACACGGAGGATGTCGGTGTGGTGTGCAGCGACAAAAGGATTCC
TGGGTTCAAATTTGACAATTCGTTGATCAACCAGATAGAGAACCTGAATATCCAGGTGGAGGACATTCGG
ATTCGAGCCATCCTCTCAACCTACCGCAAGCGCACCCCAGTGATGGAGGGCTACGTGGAGGTGAAGGAGG
GCAAGACCTGGAAGCAGATCTGTGACAAGCACTGGACGGCCAAGAATTCCCGCGTGGTCTGCGGCATGTT
TGGCTTCCCTGGGGAGAGGACATACAATACCAAAGTGTACAAAATGTTTGCCTCACGGAGGAAGCAGCGC
TACTGGCCATTCTCCATGGACTGCACCGGCACAGAGGCCCACATCTCCAGCTGCAAGCTGGGCCCCCAGG
TGTCACTGGACCCCATGAAGAATGTCACCTGCGAGAATGGCTACCGGCCGTGGTGAGTTGTGTGCCTGG
GCAGGTCTTCAGCCCTGACGGACCCTCGAGATTCCGGAAAGCGTACAAGCCAGAGCAACCCCTGGTGCGA
CTGAGAGGCGGTGCCTACATCGGGGAGGGCCGCGTGGAGGTGCTCAAAAATGGAGAGTGGGGACCGTCT
GCGACGACAAGTGGGACCTGGTGTCGGCCAGTGTGGTCTGCAGAGAGCTGGGCTTTGGGAGTGCCAAAGA
GGCAGTCACTGGCTCCCGACTGGGGCAAGGGATCGGACCCATCCACCTCAACGAGATCCAGTGCACAGGC

Figure 20 (Continued)

```
AATGAGAAGTCCATTATAGACTGCAAGTTCAATGCCGAGTCTCAGGGCTGCAACCACGAGGAGGATGCTG
GTGTGAGATGCAACACCCCTGCCATGGGCTTGCAGAAGAAGCTGCGCCTGAACGGCGGCCGCAATCCCTA
CGAGGGCCGAGTGGAGGTGCTGGTGGAGAGAAACGGGTCCCTTGTGTGGGGGATGGTGTGTGGCCAAAAC
TGGGGCATCGTGGAGGCCATGGTGGTCTGCCGCCAGCTGGGCCTGGGATTCGCCAGCAACGCCTTCCAGG
AGACCTGGTATTGGCACGGAGATGTCAACAGCAACAAAGTGGTCATGAGTGGAGTGAAGTGCTCGGGAAC
GGAGCTGTCCCTGGCGCACTGCCGCCACGACGGGGAGGACGTGGCCTGCCCCCAGGGCGGAGTGCAGTAC
GGGGCCGGAGTTGCCTGCTCAGAAACCGCCCCTGACCTGGTCCTCAATGCGGAGATGGTGCAGCAGACCA
CCTACCTGGAGGACCGGCCCATGTTCCTGCTGCAGTGTGCCATGGAGGAGAACTGCCTCTCGGCCTCAGC
CGCGCAGACCGACCCCACCACGGGCTACCGCCGGCTCCTGCGCTTCTCCTCCCAGATCCACAACAATGGC
CAGTCCGACTTCCGGCCCAAGAACGGCCGCCACGCGTGGATCTGGCACGACTGTCACAGGCACTACCACA
GCATGGAGGTGTTCACCCACTATGACCTGCTGAACCTCAATGGCACCAAGGTGGCAGAGGGCCACAAGGC
CAGCTTCTGCTTGGAGGACACAGAATGTGAAGGAGACATCCAGAAGAATTACGAGTGTGCCAACTTCGGC
GATCAGGGCATCACCATGGGCTGCTGGGACATGTACCGCCATGACATCGACTGCCAGTGGGTTGACATCA
CTGACGTGCCCCCTGGAGACTACCTGTTCCAGGTTGTTATTAACCCCAACTTCGAGGTTGCAGAATCCGA
TTACTCCAACAACATCATGAAATGCAGGAGCCGCTATGACGGCCACCGCATCTGGATGTACAACTGCCAC
ATAGGTGGTTCCTTCAGCGAAGAGACGGAAAAAAAGTTTGAGCACTTCAGCGGGCTCTTAAACAACCAGC
TGTCCCCGCAGTAAAGAAGCCTGCGTGGTCAACTCCTGTCTTCAGGCCACACCACATCTTCCATGGGACT
TCCCCCCAACAACTGAGTCTGAACGAATGCCACGTGCCCTCACCCAGCCCGGCCCCCACCCTGTCCAGAC
CCCTACAGCTGTGTCTAAGCTCAGGAGGAAAGGGACCCTCCCATCATTCATGGGGGCTGCTACCTGACC
CTTGGGGCCTGAGAAGGCCTTGGGGGGGTGGGGTTTGTCCACAGAGCTGCTGGAGCAGCACCAAGAGCCA
GTCTTGACCGGGATGAGGCCCACAGACAGGTTGTCATCAGCTTGTCCCATTCAAGCCACCGAGCTCACCA
CAGACACAGTGGAGCCGCGCTCTTCTCCAGTGACACGTGGACAAATGCGGGCTCATCAGCCCCCCAGAG
AGGGTCAGGCCGAACCCCATTTCTCCTCCTCTTAGGTCATTTTCAGCAAACTTGAATATCTAGACCTCTC
TTCCAATGAAACCCTCCAGTCTATTATAGTCACATAGATAATGGTGCCACGTGTTTTCTGATTTGGTGAG
CTCAGACTTGGTGCTTCCCTCTCCACAACCCCCACCCCTTGTTTTTCAAGATACTATTATTATATTTTCA
CAGACTTTTGAAGCACAAATTTATTGGCATTTAATATTGGACATCTGGGCCCTTGGAAGTACAAATCTAA
GGAAAAACCAACCCACTGTGTAAGTGACTCATCTTCCTGTTGTTCCAATTCTGTGGGTTTTTGATTCAAC
GGTGCTATAACCAGGGTCCTGGGTGACAGGGCGCTCACTGAGCACCATGTGTCATCACAGACACTTACAC
ATACTTGAAACTTGGAATAAAAGAAAGATTTATGAAAAAAAAAAAAAAAAAAA

>gi|33990873|gb|BC000770.2| Homo sapiens death inducer-obliterator 1, mRNA (cDNA
clone IMAGE:3506207), complete cds
GGAGCTTACTCCACGGGAACAGCCTCTAGATAATCTGAGTTGTTGAAAATACGAAGCCTGTTACTCGTGA
ACAGTGGCTGACAACAGTGTTGTTGTGAGCCTGGCTGTCTGCTTGGACCCAGAGGTTTCGTCTGCCAGGG
TTTTTGGTTGTATTTAGGATTTCAGGGAAAAGTGTCCAAGCTTTCAGTGTTGGAGCAGGTATGGACGACA
AAGGCGACCCGAGCAATGAGGAGGCACCTAAGGCCATCAAACCCACCAGCAAAGAGTTCAGGAAAACATG
GGGTTTTCGAAGGACCACTATCGCCAAGCGAGAGGGCGCAGGGGACGCGGAGGCTGACCCACTGGAGCCG
CCACCCCACAGCAGCAGCTGGGCCTGTCCCTGCGGCGCAGTGGGAGGCAGCCCAAGCGCACTGAGCGCG
TGGAGCAGTTCCTGACCATTGCGCGGCGCCGCGGCAGGAGGAGCATGCCTGTCTCCCTGGAGGATTCTGG
TGAGCCCACGTCCTGCCCCGCCACAGACGCCGAGACAGCCTCCGAGGGCAGCGTGGAAAGCGCTTCTGAG
ACCAGAAGCGGCCCCCAGTCTGCTTCCACAGCTGTGAAGGAACGACCAGCCTCTTCTGAAAAGGTGAAAG
GAGGGGATGACCACGATGACACCTCCGATAGTGACAGCGATGGCCTGACCTTGAAAGAGCTTCAGAATCG
```

Figure 20 (Continued)

```
CCTTCGCAGGAAGCGGGAACAGGAGCCCACTGAGAGGCCCCTGAAAGGGATCCAGAGTCGCCTGCGGAAG
AAGCGCCGGGAGGAGGGTCCCGCCGAGACTGTGGGCTCCGAGGCCAGTGACACTGTGGAGGGCGTCCTGC
CCAGTAAGCAGGAGCCCGAGAACGATCAGGGGGTTGTGTCCCAGGCTGGGAAAGATGACAGAGAGAGTAA
GTTGGAGGGAAAGGCGGCTCAGGACATCAAAGATGAGGAGCCTGGAGACTTGGGCCGACCGAAGCCTGAA
TGTGAGGGTTACGACCCCAACGCCCTGTATTGCATTTGCCGCCAGCCTCACAACAACAGGTTTATGATTT
GCTGTGACCGCTGTGAAGAATGGTTTCATGGCGATTGTGTGGGCATTTCTGAGGCTCGAGGGAGGCTTTT
GGAAAGGAATGGGGAAGACTATATCTGCCCAAACTGCACCATTCTGCAAGTGCAGGATGAGACTCATTCA
GAAACGGCAGATCAGCAGGAAGCTAAATGGAGACCTGGAGATGCTGATGGCACCGATTGTACAAGTATAG
GAACAATAGAGCAGAAGTCTAGCGAAGACCAAGGGATAAAGGGTAGAATTGAGAAAGCTGCAAATCCAAG
TGGCAAGAAGAAACTCAAGATCTTCCAGCCTGTGATAGAGGCGCCTGGTGCCTCAAAATGTATTGGCCCC
GGGTGCTGTCACGTGGCGCAGCCCGACTCGGTGTACTGCAGTAATGACTGTATCCTCAAACACGCCGCAG
CGACAATGAAGTTTCTAAGCTCAGGTAAAGAACAGAAGCCAAAGCCTAAAGAAAAGATGAAGATGAAGCC
AGAGAAGCCCAGTCTTCCGAAATGCGGTGCTCAGGCAGGTATTAAAATCTCTTCTGTGCACAAGAGACCA
GCTCCAGAAAAAAAAGAGACCACAGTGAAGAAGGCAGTGGTGGTCCCTGCGCGGAGTGAAGCACTCGGGA
AGGAAGCAGCTTGTGAGAGCAGCACGCCGTCGTGGGCGAGCGATCACAATTACAATGCAGTAAAGCCAGA
AAAGACTGCTGCTCCCTCGCCGTCACTGTTGTATAAATGCTCTGGTAAGTATTTGTATTCTCTTCATCCC
AGTCTGATTGCATAGCCACACTGCCCGGCACGCCACATCCACCCCTGTCTGCACATGAGTTGTTCTGACA
ACAGCGCTGTATACGCTTCAGTTTTTCCACATTGTCCACGGCCAGCACATGAAAGCATCACTTCTTTTTT
ATGTTGTGGGAATCTTTGCAAGTTAGTGTTGCATCTGATTTTCAGGTGTACATTTATTTTTGACTGGGCA
GATAGGGGATTTTTTTTTTTCCATGTCCGATTCACACGCTACACACCCACATGAACACATTCGAACTTCG
AAGGCCACACACTCCTGCTTCATAGGCCCCACGGTAAGTGAGTTCACACCTAGAACACTGTCCTGACCGC
AGGACGCGTGCCTTGGACTTGGTATTCTACATGTGACTGGCTTTCTTGCCCTCGTCTCTTGAATGTTTAG
ACTCTTAAGATCATATCCTGCCCCAAATTTCAAATTAATGAAATGAAGATATTTCAAACAGATCTTTGAA
ACCTCAGATTCTGTGGTGCAATTTTAATGTTTTCTTGTTTCTCAGTTTTCTGCTATAAAACTATTTTCAA
TTCAAAAAAAAAAAAAAAAAAAAAAAA

>gi|33875920|gb|BC001048.2| Homo sapiens PCTAIRE protein kinase 1, mRNA (cDNA
clone MGC:1330 IMAGE:3504276), complete cds
GGAGGGGGCAGTTGGGCGGGATAGGCCGTCCTAGCTAAGGTGGTAAAGGCCAATAACTCTTCAGGCTGC
CTCTCCTCGAAAAGTCATCTTCTCGCGAACCTTTAAAATGCCTTCCTCCCCAAGCACCTCAAGGGACTAG
AACTGAGTGCTTCATTTGTCTTTTTTCCTCCTTGCAAAAGTCCCGTTTGCCACCATGGGGATGTACCAAG
TGAGACCGAGTAGGGGGAACGAGTGGTGATTGACGCGCCAGGTTACTGGCCACTGCTCACCTAGGCGCTA
GCAAACTTCTGCCAAGATCGGAACTGAGTACTAAACAGCCTCCACAGTTCTCCCTGGTGCCGTCTCCGGC
TTGGCGCCGCATCCTCCTCTGGGCTCGCGATGGCCGCGTCCCCTCCCGCTGCGGACGGGTCCTTTGGTAC
ATGCAGTCCGAGATCGCCATGGATCGGATGAAGAAGATCAAACGGCAGCTGTCAATGACACTCCGAGGTG
GCCGAGGCATAGACAAGACCAATGGTGCCCCTGAGCAGATAGGCCTGGATGAGAGTGGTGGTGGTGGCGG
CAGTGACCCTGGAGAGGCCCCCACACGTGCTGCTCCTGGGGAACTTCGTTCTGCACGGGGCCCACTCAGC
TCTGCACCAGAGATTGTGCACGAGGACTTGAAGATGGGGTCTGATGGGGAGAGTGACCAGGCTTCAGCCA
CGTCCTCGGATGAGGTGCAGTCTCCAGTGAGAGTGCGTATGCGCAACCATCCCCACGCAAGATCTCCAC
TGAGGACATCAACAAGCGCCTATCACTACCAGCTGACATCCGGCTGCCTGAGGGCTACCTGGAGAAGCTG
ACCCTCAATAGCCCCATCTTTGACAAGCCCCTCAGCCGCCGCCTCCGTCGTGTCAGCCTATCTGAGATTG
GCTTTGGGAAACTGGAGACCTACATTAAGCTGGACAAACTGGGCGAGGGTACCTATGCCACCGTCTACAA
```

Figure 20 (Continued)

```
AGGCAAAAGCAAGCTCACAGACAACCTTGTGGCACTCAAGGAGATCAGACTGGAACATGAAGAGGGGCA
CCCTGCACCGCCATCCGGGAAGTGTCCCTACTCAAGGACCTCAAACACGCCAACATCGTTACGCTACATG
ACATTATCCACACGGAGAAGTCCCTCACCCTTGTCTTTGAGTACCTGGACAAGGACCTGAAGCAGTACCT
GGATGACTGTGGGAACATCATCAACATGCACAACGTGAAACTGTTCCTGTTCCAGCTGCTCCGTGGCCTG
GCCTACTGCCACCGGCAGAAGGTGCTACACCGAGACCTCAAGCCCCAGAACCTGCTCATCAACGAGAGGG
GAGAGCTCAAGCTGGCTGACTTTGGCCTGGCCCGAGCCAAGTCAATCCCAACAAAGACATACTCCAATGA
GGTGGTGACACTGTGGTACCGGCCCCCTGACATCCTGCTTGGGTCCACGGACTACTCCACTCAGATTGAC
ATGTGGGGTGTGGGCTGCATCTTCTATGAGATGGCCACAGGCCGTCCCCTCTTTCCGGGCTCCACGGTGG
AGGAACAGCTACACTTCATCTTCCGTATCTTAGGAACCCCAACTGAGGAGACGTGGCCAGGCATCCTGTC
CAACGAGGAGTTCAAGACATACAACTACCCCAAGTACCGAGCCGAGGCCCTTTTGAGCCACGCACCCCGA
CTTGATAGCGACGGGGCCGACCTCCTCACCAAGCTGTTGCAGTTTGAGGGTCGAAATCGGATCTCCGCAG
AGGATGCCATGAAACATCCATTCTTCCTCAGTCTGGGGAGCGGATCCACAAACTTCCTGACACTACTTC
CATATTTGCACTAAAGGAGATTCAGCTACAAAAGGAGGCCAGCCTTCGGTCTTCGTCGATGCCTGACTCA
GGCAGGCCAGCTTTCCGCGTGGTGGACACCGAGTTCTAAGCCACAGACCGAGGCCCCAGCAGGCAGCGGC
TGGAGGGATGCCACACCCCTCACAGGGCAGCCCCCAACTACATCTTCCCTGCTTACTCTCTGCCTACCTG
CCTGAGCCATGTTCACCTGCCCACTTGTCCCCTGCTGCCTGCCCAAACACCCCACCATTGGCCTGTCAAC
CCACCCATTGGCCTGTCTGCTGGGTGCTAACAAAGCTCTCATCACTCCTTCAAAAAAAAAAAAAAAAAAA
AAAAAA

>gi|33876155|gb|BC001396.2| Homo sapiens methyltransferase like 11A, mRNA (cDNA
clone MGC:783 IMAGE:3050940), complete cds
CGAGCTGTCGCGTCTGGTCGTGGTCTGGCGGAGCTGCGGTTGGCTTGTGGCGTCTCCGCCGCCGCCGCC
TCCCTTCCTCTTCCCCATCTTCTTCTCTCGGTCCCGGGAGCCCCGCCCGGAGAGAGTCGCGGTTGCTGA
TCGTGGTGCTTGAGTAGAGCCGTGGTTGGTGACAGCATGACGAGCGAGGTGATAGAAGACGAGAAGCAAT
TCTATTCCAAGGCCAAGACCTACTGGAAACAAATCCCACCCACGGTGGACGGCATGCTTGGGGGGTATGG
CCACATCTCCAGCATCGACATCAACAGCTCCCGGAAGTTTCTGCAGAGGTTTTTGAGGGAAGGCCCGAAC
AAGACAGGAACGTCCTGTGCCCTGGACTGTGGAGCTGGCATTGGGAGGATCACCAAGCGGCTGCTCCTGC
CGCTGTTCAGAGAGGTGGATATGGTCGACATAACGGAGGACTTCCTGGTTCAAGCCAAGACCTACCTGGG
GGAGGAGGGCAAGAGGGTGAGGAACTACTTCTGTTGTGGGCTCCAGGACTTCACCCCGGAGCCGGACTCT
TACGACGTGATCTGGATCCAGTGGGTGATAGGCCACCTCACCGATCAGCACCTGGCCGAGTTCCTGCGGC
GCTGCAAGGGCAGCCTCCGCCCCAACGGCATCATCGTCATCAAAGACAACATGGCCCAGGAGGGCGTGAT
TCTGGACGACGTGGACAGCAGCGTGTGCCGGGACCTTGACGTGGTCCGCAGGATCATCTGCAGTGCAGGC
CTCAGCCTCCTGGCCGAGGAGAGGCAGGAGAACCTCCCCGATGAGATCTACCATGTCTATAGCTTTGCCC
TGAGATGAGCCGGGCTGGCAGGAGAAACTGAGGAACCACAGTCCTGGTGGGGGAGCTGGCAGCTGGGC
AAGATCCAGGCGCCACGCTGGCGGTTCGTGAGTGTCGAGGCACCACTAAATATAGCTGTCTGCCGTCCAC
TCAAAAAAAAAAAAAAAAAAAA >gi|12804690|gb|BC001772.1| Homo sapiens glutaminyl-tRNA synthetase, mRNA (cDNA
clone IMAGE:3543728), partial cds
TGAAGTGGGCAGATGGCAAAATGATCAAGAATGAAGTGGACATGCAGGTCCTCCACCTTCTGGGCCCCAA
GTTGGAGGCTGATCTGGAGAAGAAGTTCAAGGTGGCAAAAGCTCGGCTAGAAGAAACAGACCGGAGGACG
GCAAAGGATGTGGTGGAGAATGGCGAGACTGCTGACCAGACCCTGTCTCTGATGGAGCAGCTCCGGGGGG
```

Figure 20 (Continued)

```
AGGCCCTTAAGTTCCACAAGCCTGGTGAGAACTACAAGACCCCAGGCTATGTGGTCACTCCACACACCAT
GAATCTACTAAAGCAGCACCTGGAGATTACTGGTGGGCAGGTACGTACCCGGTTCCCGCCAGAACCCAAT
GGAATCCTGCATATTGGACATGCCAAAGCCATCAATTTCAACTTTGGCTATGCCAAGGCCAACAATGGCA
TCTGTTTTCTGCGTTTTGATGACACCAACCCTGAGAAGGAGGAAGCAAAGTTCTTCACGGCCATCTGTGA
CATGGTAGCCTGGCTAGGCTACACACCTTACAAAGTCACATATGCGTCTGACTATTTTGACCAGCTATAT
GCGTGGGCTGTGGAGCTCATCCGCAGGGGTCTGGCTTATGTGTGCCACCAGCGAGGAGAGGAGCTCAAAG
GCCATAATACTCTGCCTTCACCCTGGAGAGACCGTCCCATGGAGGAGTCACTGCTGCTCTTTGAGGCAAT
GCGCAAGGGCAAGTTTTCAGAGGGCGAGGCCACACTACGGATGAAGCTGGTGATGGAGGATGGCAAGATG
GACCCTGTAGCCTATCGAGTCAAGTATACACCACACCACCGCACAGGGGACAAATGGTGCATCTATCCCA
CCTACGACTACACACACTGCCTCTGTGACTCCATCGAGCACATCACTCACTCACTCTGCACCAAGGAATT
CCAGGCCCGACGCTCTTCCTACTTCTGGCTTTGCAATGCACTGGACGTCTATTGCCCTGTGCAGTGGGAG
TATGGCCGCCTCAACCTGCACTATGCTGTTGTCTCTAAGAGGAAGATCCTCCAGCTTGTAGCAACTGGTG
CTGTGCGGGACTGGGATGACCCACGGCTCTTTACACTCACGGCCCTGCGACGGCGGGGCTTCCCACCTGA
GGCCATCAACAACTTCTGTGCCCGGGTGGGAGTGACTGTGGCACAAACCACAATGGAGCCACATCTTCTA
GAAGCCTGTGTGCGTGATGTGCTGAATGACACAGCCCCACGAGCCATGGCTGTGCTGGAGTCACTACGGG
TCATCATCACCAACTTTCCTGCTGCCAAGTCCTTGGACATCCAGGTGCCCAACTTCCCAGCTGATGAGAC
CAAAGGCTTCCATCAGGTTCCCTTTGCACCCATTGTCTTCATTGAGAGGACTGACTTCAAGGAGGAGCCA
GAGCCAGGATTTAAGCGCCTGGCTTGGGGCCAGCCTGTGGGCCTGAGGCATACAGGCTACGTCATTGAGC
TGCAGCATGTTGTCAAGGGCCCCAGTGGTTGTGTAGAGAGTCTGGAGGTGACCTGCAGACGGGCAGATGC
TGGAGAGAAGCCAAAGGCCTTTATTCACTGGGTGTCACAGCCTTTGATGTGTGAGGTTCGCCTCTATGAG
CGACTATTCCAGCACAAGAACCCTGAAGATCCTACTGAGGTGCCTGGTGGATTTTTAAGTGACCTGAACC
TGGCATCACTACACGTGGTGGATGCAGCATTAGTGGACTGCTCTGTGGCCCTGGCAAAACCCTTCGACAA
GTTCCAGTTTGAGCGTCTTGGATATTTCTCCGTGGATCCAGACAGCCATCAGGGAAAGCTTGTCTTTAAC
CGAACTGTCACACTGAAGGAAGACCCAGGAAAGGTGTGAGCTGGAAGCACTGAACCTACCTCATCCTCCT
GGAGGGTGTGGCTACCCTCGCCACCCCAAATTCCATGTCAATAAAGAACAGCTAAATTCTCCTAGAAAAA
AAAAAAAAAAAAAAAA
```

```
>gi|33877125|gb|BC002755.2| Homo sapiens MAP kinase interacting serine/threonine
kinase 1, mRNA (cDNA clone MGC:3690 IMAGE:3629765), complete cds
GCGACCGCTCCCCGGCGGGAGCCAGCGAAGGTTTCCATGTCAGAGGCCGATGGAGAACTGAAGATTGCCA
CCTACGCACAAAGGCCATTGAGACACTTCGTGTAGCTGGAAGACACCAACTTCCTGACAGGAGCTTTATT
TCATTTGGGATTTCAAGTTTACAGATGGTATCTTCTCAAAAGTTGGAAAAACCTATAGAGATGGGCAGTA
GCGAACCCCTTCCCATCGCAGATGGTGACAGGAGGAGGAAGAAGAAGCGGAGGGGCCGGGCCACTGACTC
CTTGCCAGGAAAGTTTGAAGATATGTACAAGCTGACCTCTGAATTGCTTGGAGAGGGAGCCTATGCCAAA
GTTCAAGGTGCCGTGAGCCTACAGAATGGCAAAGAGTATGCCGTCAAAATCATCGAGAAACAAGCAGGGC
ACAGTCGGAGTAGGGTGTTTCGAGAGGTGGAGACGCTGTATCAGTGTCAGGGAAACAAGAACATTTTGGA
GCTGATTGAGTTCTTTGAAGATGACACAAGGTTTTACTTGGTCTTTGAGAAATTGCAAGGAGGTTCCATC
TTAGCCCACATCCAGAAGCAAAAGCACTTCAATGAGCGAGAAGCCAGCCGAGTGGTGCGGGACGTTGCTG
CTGCCCTTGACTTCCTGCATACCAAAGACAAAGTCTCTCTCTGTCACCTAGGCTGGAGTGCTATGGCGCC
ATCAGGGCTCACTGCAGCCCCAACCTCCCTGGGCTCCAGTGATCCTCCCACCTCAGCCTCCCAAGTAGCT
GGGACTACAGGCATTGCTCATCGTGATCTGAAACCAGAAAATATATTGTGTGAATCTCCAGAAAAGGTGT
CTCCAGTGAAAATCTGTGACTTTGACTTGGGCAGTGGGATGAAACTGAACAACTCCTGTACCCCCATAAC
```

Figure 20 (Continued)

```
CACACCAGAGCTGACCACCCCATGTGGCTCTGCAGAATACATGGCCCCTGAGGTAGTGGAGGTCTTCACG
GACCAGGCCACATTCTACGACAAGCGCTGTGACCTGTGGAGCCTGGGCGTGGTCCTCTACATCATGCTGA
GTGGCTACCCACCCTTCGTGGGTCACTGCGGGCCGACTGTGGCTGGGACCGGGGCGAGGTCTGCAGGGT
GTGCCAGAACAAGCTGTTTGAAAGCATCCAGGAAGGCAAGTATGAGTTTCCTGACAAGGACTGGGCACAC
ATCTCCAGTGAAGCCAAAGACCTCATCTCCAAGCTCCTGGTGCGAGATGCAAAGCAGAGACTTAGCGCCG
CCCAAGTTCTGCAGCACCCATGGGTGCAGGGGCAAGCTCCAGAAAAGGGACTCCCCACGCCGCAAGTCCT
CCAGAGGAACAGCAGCACAATGGACCTGACGCTCTTCGCAGCTGAGGCCATCGCCCTTAACCGCCAGCTA
TCTCAGCACGAAGAGAACGAACTAGCAGAGGAGCCAGAGGCACTAGCTGATGGCCTCTGCTCCATGAAGC
TTTCCCCTCCCTGCAAGTCACGCCTGGCCCGGAGACGGGCCCTGGCCCAGGCAGGCCGTGGTGAAGACAG
GAGCCCGCCACAGCACTCTGAAATGCTCCAGTCACACCTTATAGGCCCTAGGCCTGGCCAGGCATTGTC
CCCTGGAAACCTGTGTGGCTAAAGTCTGCTGAGCAGGCAGCAGCCTCTGCTCTGTGGCTCCATTCAGGCT
TTTTCATCTACGAAGGCCCTGAGGTTCCCATCAACCCCCATTTCCCTAGGGTCCTGGAGGAAAAAGCTTT
TTCCAAAGGGGTTGTCTTTGAAAAGGAAAGCAATCACTTCTCACTTTGCATAATTGCCTGCAGCAGGAAC
ATCTCTTCACTGGGCTCCACCTGCTCACCCGCCTGCAGATCTGGGATCCAGCCTGCTCTCACCGCTGTAG
CTGTGGCGGCTGGGGCTGCAGCCTGCAGGGAGAAGCAAGAAGCATCAGTTGACAGAGGCTGCCGACACGT
GCCTCTTCCCTCTCTTCTCTGTCACCCTCCTCTGGCGGTCCTTCCACCTTCCTCTGTCCTCCGGATGTCC
TCTTTGCCCGTCTTCTCCCTTGGCTGAGCAAAGCCATCCCCTCAATTCAGGGAAGGGCAAGGAGCCTTCC
TCATTCAGGAAATCAAATCAGTCTTCCGGTCTGCAGCACGGAAAAGCACATAATCTTTCTTTGCTGTGAC
TGAAATGTATCCCTCGTTTATCATCCCCTTTGTTTGTGATTGCTGCTAAAGTCAGTAGTATCGTTTTTTT
AAAAAAAAAGTTTGGTGTTTTTAACCATGCTGTTCCAGCAAAGATGATACCTTAAACTCCCACTGCAAGC
CCATGAACTTCCCAGAGAGTGGAACGGCTTGCTCTTCTTTCTAGAATGTCCATGCACTTGGGTTTTAATC
AGCAGTTCCCTATTATTCTGATTTTAAGCTGTTCCTGTGATGAACTTAGAGACAGCATCGGTGTCTGCTG
CTGTGTCCCCAGGTCTTGTGTGGGTGGCACAGATCTGGGCAGTTAGATAGTGCTCTGTGCCTAAGGTGAA
GCCACACTAGGGTGAAGCCTCACTTCCCTGTTTGAGCAATGCAGTGCCTGCTGCCCGTGTGCATGAAGGT
ACAGCCATTCAGATAAGTGGAACTATTGAGTTACATAAAGAAAATAGATTTGCATTTGTCAGGCAGACGT
TTATACAACACCACGGTGCTTTTATACATTGTGCTTATTTTAATAAAACTGAAATTCTAAAAAAAAAAAA
AAAAAA

>gi|13436367|gb|BC004967.1| Homo sapiens UBA domain containing 1, mRNA (cDNA
clone MGC:2352 IMAGE:3535682), complete cds
CCGCGACGGCGCGCCCCGGCGGCTGCTGCGGCGGCGGGAGCGAGGCGACCGCTGAGGCCGCGGAGAGTG
ACGGCGGCCCGGCCGACGGGAGCCGGGGCGGGGCGGCGGCCCAGCGAAGGAGCGCGCGGGCGGTCTGGCC
CCGCCCCCTCCCCGCCCGCCTTCCCGGTGACCTTCAGGGGCCCGGGTGGCGGGCGCAGGCCCCTGCGGCG
GCGGCGGGATGTTCGTGCAGGAGGAGAAGATCTTCGCGGGCAAGGTGCTGCGGCTGCACATCTGCGCGTC
CGACGGCGCCGAGTGGCTGGAGGAGGCCACCGAGGACACCTCGGTGGAGAAGCTCAAGGAGCGCTGCCTC
AAGCACTGTGCTCATGGGAGCTTAGAAGATCCCAAAAGTATAACCCATCATAAATTAATCCACGCTGCCT
CAGAGAGGGTGCTGAGTGATGCCAGGACCATCCTGGAAGAGAACATCCAGGACCAAGATGTCCTATTATT
GATAAAAAAGCGTGCTCCATCACCACTTCCCAAGATGGCTGATGTCTCAGCAGAAGAAAAGAAAAAACAA
GACCAGAAAGCTCCAGATAAAGAGGCCATACTGCGGGCCACCGCCAACCTGCCCTCCTACAACATGGACC
GGGCCGCGGTCCAGACCAACATGAGAGACTTCCAGACAGAACTCCGGAAGATACTGGTGTCTCTCATCGA
GGTGGCGCAGAAGCTGTTAGCGCTGAACCCAGATGCGGTGGAATTGTTTAAGAAGGCGAATGCAATGCTG
GACGAGGACGAGGATGAGCGTGTGGACGAGGCTGCCCTGCGGCAGCTCACGGAGATGGGCTTTCCGGAGA
```

Figure 20 (Continued)

```
ACAGAGCCACCAAGGCCCTTCAGCTGAACCACATGTCGGTGCCTCAGGCCATGGAGTGGCTAATTGAACA
CGCAGAAGACCCGACCATAGACACGCCTCTTCCTGGCCAAGCTCCCCAGAGGCCGAGGGGGCCACAGCA
GCTGCCTCCGAGGCTGCCGCGGGAGCCAGCGCCACCGATGAGGAGGCCAGAGATGAGCTGACGGAAATCT
TCAAGAAGATCCGGAGGAAAAGGGAGTTTCGGGCTGATGCTCGGGCCGTCATTTCCCTGATGGAGATGGG
GTTCGACGAGAAAGAGGTGATAGATGCCCTCAGAGTGAACAACAACCAGCAGAATGCCGCGTGCGAGTGG
CTGCTGGGGGACCGGAAGCCCTCTCCGGAGGAGCTGGACAAGGGCATCGACCCCGACAGTCCTCTCTTTC
AGGCCATCCTGGATAACCCGGTGGTGCAGCTGGGCCTGACCAACCCGAAAACATTGCTAGCATTTGAAGA
CATGCTGGAGAACCCACTGAACAGCACCCAGTGGATGAATGATCCAGAAACGGGGCCTGTCATGCTGCAG
ATCTCTAGAATCTTCCAGACACTAAATCGCACGTAGGTGGCGTTGTTCCACTCGGCTATCAGGCCACAGC
AGCCCCCTGGTGCGGCCCGAGACCGGGCAGAGTGGACCTCACCTGGAAACTCACCTTCAGCGCCTCAGCC
CTGGACTGTTAGAGGTGCTGCAGCGGCTCCTGCTCTCTGATCTTATTGCTTATAAACTTTGGTGACGGTA
GTGTGTAAGGCCGTATTTTTAGCATCTGACAGGTGTTTACAAAAAAGTGGTTGTCGCACTGGGAAGTGGA
GTGATGGCCTCGTCTCCAGTGCTCCTCTGGGCTCTTGAGTTGCTGCTTGAATTGCCGTGTAGACATTTGC
TTGGAGAGTCCACTTGTTATTTGACGGAGGTAGGTTTCAACCCAGAGTTAATGTCAAGCATGCTAATTTA
ACTAGTCACTCACAGATGACTTTTCTTTAATAAAGTCCCTTTTCCTAAAAAAAAAAAAAAAAAAAA

>gi|13543647|gb|BC005974.1| Homo sapiens vesicle-associated membrane protein 4,
mRNA (cDNA clone MGC:14658 IMAGE:4102457), complete cds
ACCGCCAGCCGGGAGAGCTGCCGGGAGTTCCCCGGGAGCGCTGCCGGGAGTTCCCCGGGAGCCTCAGGT
GGTGACTATCCTGTTGAGAAGCAAAAGATACTTTGCAAGTAAAAAATATGCCTCCCAAGTTTAAGCGCCA
CCTCAATGATGATGATGTCACAGGTTCTGTGAAAAGTGAAAGGAGAAATCTTTTGGAAGATGATTCAGAT
GAAGAAGAGGACTTTTTTCTAAGGGGACCATCTGGACCAAGATTTGGACCTAGAAATGATAAAATTAAGC
ATGTTCAGAATCAAGTGGATGAAGTTATTGATGTCATGCAAGAAAATATTACAAAGGTAATTGAGAGAGG
GGAGAGACTAGATGAACTACAGGACAAATCAGAAAGCTTATCGGATAATGCAACAGCTTTTAGCAACAGA
TCCAAACAACTTCGAAGGCAAATGTGGTGGCGTGGATGCAAAATAAAAGCCATCATGGCTTTGGTTGCTG
CTATCCTTTTGCTAGTGATTATCATTCTTATAGTCATGAAATACCGTACTTGATTTGATGACAGAGATCT
TCATTAAACAAGATCTGGGACAGTAATAAAAGATTGCTGCATAATTTAAATGAAACCTATGTGTATATAA
CTTTCAAAACTTCTTTTTCAAGAAACTAAGAGGCAAGTATCACTTCAAATTGGAACGTTGAGAATGTCCA
ATTATCTTCTCCCTTTCTAACAAAATGTTCTTTTAATAATTATGTTTAAGGCAAAGAGAACTAGCCTCTA
TTTTTCCATATTTCAAGGATCTAATTTGAAACTAGATACTTGCCAGTTCATTATTTGTGTATATAAACAC
TGATTATAATATTTCATATTAATATTTTAATGGCATAAGGACTTGCATTATTGCATTAGGGAGCGGGTCA
TGCTGGTGGTCAGGAAGCCTGTGTAGAGTACCAAATTATATGTTGAAAGAGATGCATAACCATTCTGTCA
ATATTTGCAGAAATATAGTTCCTTTCATATTACAGTTGTTTTGCAAGCAATTTCCACATTTATAGGTGTA
ACAAAAGCTAAATGTTGTAAATGTTGTTGCCCTCAGGTATAACTAAAAACATTCCAGTAAATATATTTTT
GACTGTGTAAAAAAAAAAAAAAAAAAAAAAAAAAAAA >gi|13937832|gb|BC007019.1| Homo sapiens vesicle-associated membrane protein 4,
mRNA (cDNA clone MGC:12355 IMAGE:3961237), complete cds
GATCGGCTCGATGAGCGGAGGCGCTGCTGCGGCGCTGCGGCCGACGCCGGGTCCGCACCAACTGTCTCCC
CCTCCCAGCTTCTTACCTCGGCTTCCTACTCCTTCCCCCGCCCGCCCAGCACCGCCAGCCCGGGAGAGCT
GCCGGGAGTTCCCCGGGAGCCTCAGGTGGTGACTATCCTGTTGAGAAGCAAAAGATACTTTGCAAGTAAA
AAATATGCCTCCCAAGTTTAAGCGCCACCTCAATGATGATGATGTCACAGGTTCTGTGAAAAGTGAAAGG
```

Figure 20 (Continued)

```
AGAAATCTTTTGGAAGATGATTCAGATGAAGAAGAGGACTTTTTTCTGGGACCATCTGGACCAAGATTTG
GACCTAGAAATGATAAAATTAAGCATGTTCAGAATCAAGTGGATGAAGTTATTGATGTCATGCAAGAAAA
TATTACAAAGGTAATTGAGAGAGGGGAGAGACTAGATGAACTACAGGACAAATCAGAAAGCTTATCGGAT
AATGCAACAGCTTTTAGCAACAGATCCAAACAACTTCGAAGGCAAATGTGGTGGCGTGGATGCAAAATAA
AAGCCATCATGGCTTTGGTTGCTGCTATCCTTTTGCTAGTGATTATCATTCTTATAGTCATGAAATACCG
TACTTGATTTGATGACAGAGATCTTCATTAAACAAGATCTGGGACAGTAATAAAAGATTGCTGCATAATT
TAAATGAAACCTATGTGTATATAACTTTCAAAACTTCTTTTTCAAGAAACTAAGAGGCAAGTATCACTTC
AAATTGGAACGTTGAGAATGTCCAATTATCTTCTCCCTTTCTAACAAAATGTTCTTTTAATAATTATGTT
TAAGGCAAAGAGAACTAGCCTCTATTTTTCCATATTTCAAGGATCTAATTTGAAACTAGATACTTGCCAG
TTCATTATTTGTGTATATAAACACTGATTATAATATTTCATATTAATATTTTAATGGCATAAGGACTTGC
ATTATTGCATTAGGGAGCGGGTCATGCTGGGGTCAGGAAGCCTGTGTAGAGTACCAAATTATATGCTGA
AAGAGATGCATAACCATTCTGTCAATATTTGCAGAAATATAGTTCCTTTCATATTACAGTTGTTTTGCAA
GCAATTTCCACATTTATAGGTGTAACAAAAGCTAAATGTTGTAAATGTTGTTGCCCTCAGGTATAACTAA
AAAAAAAAAAAAAAAAAAAAAAAAAA

>gi|14198167|gb|BC008141.1| Homo sapiens UCHL5 interacting protein, mRNA (cDNA
clone MGC:17009 IMAGE:4154976), complete cds
GCTGGAGGTTGATTGGCGGTCTTGCCGGCCAGTGAAGCCAGGGCATGGGCGGGGCGCGGCTCGGAGCGCG
AAACATGGCGGGGCAGGACGCTGGCTGCGGCCGTGGCGGCGACGACTACTCAGAGGACGAGGGCGACAGC
AGCGTGTCCAGGGCGGCTGTGGAGGTGTTCGGGAAGCTGAAGGACCTAAACTGCCCCTTCCTCGAGGGTC
TGTATATCACAGAGCCAAAGACAATTCAGGAACTGCTGTGCAGCCCCTCAGAGTACCGCTTGGAGATCCT
AGAGTGGATGTGTACCCGGGTCTGGCCCTCACTGCAGGACAGGTTCAGCTCACTGAAAGGGGTCCCAACA
GAGGTGAAGATCCAAGAAATGACGAAGCTGGGCCACGAGCTGATGCTGTGTGCGCCAGATGACCAGGAGC
TCCTCAAGGGCTGTGCCTGCGCCCAGAAGCAGCTACACTTCATGGACCAGTTGCTCGATACCATCCGGAG
CCTGACCATTGGGTGCTCCAGTTGCTCGAGCCTGATGGAGCACTTCGAGGACACCAGGAGAAGAACGAG
GCCTTGCTGGGGAGCTCTTCTCTAGCCCCCACCTGCAGATGCTCCTGAATCCAGAGTGCGACCCGTGGC
CCCTGGACATGCAGCCCCTCCTCAACAAGCAGAGTGATGACTGGCAGTGGGCCAGTGCCTCTGCCAAGTC
CGAGGAGGAGGAGAAGCTGGCGGAGCTTGCCAGGCAGCTGCAGGAGAGTGCTGCCAAGTTGCACGCGCTT
AGAACGGAGTACTTTGCACAGCATGAGCAAGGGGCTGCTGCGGGCGCAGCCGACATCAGCACCCTAGACC
AGAAGCTGCGTCTGGTCACTTCCGACTTCCACCAGCTAATCTTGGCTTTTCTCCAAGTCTACGACGACGA
GCTGGGCGAGTGCTGCCAGCGCCCAGGCCCTGACCTCCACCCGTGCGGCCCCATCATCCAGGCCACGCAC
CAGAATCTGACTTCCTACAGCCAACTGCTGCAAGTGGTCATGGCAGTTGCTGACACCTCTGCGAAGGCCG
TGGAGACCGTGAAGAAGCAGCAAGGCGAGCAGATCTGCTGGGGTGGCAGCAGCTCCGTCATGAGTCTAGC
TACCAAGATGAATGAACTAATGGAGAAATAGAAAGTCTTCAGTGATGGCCTACGCCAAAGCACAGGATGG
GGCGGGCAGGAAGCCCTCTCCCAAGATCGAGTTGGCCGAGGATGGATGATTGTGGCAGCAGAAGCCGTTG
CAGCCCCACGTTGTGCTCTAGGCAGGGACCTTTGGCCCCTTTGGGGAGGGAGAGACAGACGGGCGGTTTG
ACTTGGACACAAAGAAAGCCTTGGTTTCTAAGCAAAAAAAAAAAAAA >gi|33869444|gb|BC008730.2| Homo sapiens hexokinase 1, mRNA (cDNA clone MGC:1724
IMAGE:3163058), complete cds
GGCTGCGGAGGACCGACCGTCCCCACGCCTGCCGCCCCGCGACCCCGACCGCCAGCATGATCGCCGCGCA
GCTCCTGGCCTATTACTTCACGGAGCTGAAGGATGACCAGGTCAAAAAGATTGACAAGTATCTGTATGCC
```

Figure 20 (Continued)

```
ATGCGGCTCTCCGATGAAACTCTCATAGATATCATGACTCGCTTCAGGAAGGAGATGAAGAATGGCCTCT
CCCGGGATTTTAATCCAACAGCCACAGTCAAGATGTTGCCAACATTCGTAAGGTCCATTCCTGATGGCTC
TGAAAAGGGAGATTTCATTGCCCTGGATCTTGGTGGGTCTTCCTTTCGAATTCTGCGGGTGCAAGTGAAT
CATGAGAAAAACCAGAATGTTCACATGGAGTCCGAGGTTTATGACACCCCAGAGAACATCGTGCACGGCA
GTGGAAGCCAGCTTTTTGATCATGTTGCTGAGTGCCTGGGAGATTTCATGGAGAAAAGGAAGATCAAGGA
CAAGAAGTTACCTGTGGGATTCACGTTTTCTTTTCCTTGCCAACAATCCAAAATAGATGAGGCCATCCTG
ATCACCTGGACAAAGCGATTTAAAGCGAGCGGAGTGGAAGGAGCAGATGTGGTCAAACTGCTTAACAAAG
CCATCAAAAAGCGAGGGGACTATGATGCCAACATCGTAGCTGTGGTGAATGACACAGTGGGCACCATGAT
GACCTGTGGCTATGACGACCAGCACTGTGAAGTCGGCCTGATCATCGGCACTGGCACCAATGCTTGCTAC
ATGGAGGAACTGAGGCACATTGATCTGGTGGAAGGAGACGAGGGGAGGATGTGTATCAATACAGAATGGG
GAGCCTTTGGAGACGATGGATCATTAGAAGACATCCGGACAGAGTTTGACAGGGAGATAGACCGGGATC
CCTCAACCCTGGAAAACAGCTGTTTGAGAAGATGGTCAGTGGCATGTACTTGGGAGAGCTGGTTCGACTG
ATCCTAGTCAAGATGGCCAAGGAGGGCCTCTTATTTGAAGGGCGGATCACCCCGGAGCTGCTCACCCGAG
GGAAGTTTAACACCAGTGATGTGTCAGCCATCGAAAAGAATAAGGAAGGCCTCCACAATGCCAAAGAAAT
CCTGACCCGCCTGGGAGTGGAGCCGTCCGATGATGACTGTGTCTCAGTCCAGCACGTTTGCACCATTGTC
TCATTTCGCTCAGCCAACTTGGTGGCTGCCACACTGGGCGCCATCTTGAACCGCCTGCGTGATAACAAGG
GCACACCCAGGCTGCGGACCACGGTTGGTGTCGACGGATCTCTTTACAAGACGCACCCACAGTATTCCCG
GCGTTTCCACAAGACTCTAAGGCGCTTGGTGCCAGACTCCGATGTGCGCTTCCTCCTCTCGGAGAGTGGC
AGCGGCAAGGGGCTGCCATGGTGACGGCGGTGGCCTACCGCTTGGCCGAGCAGCACCGGCAGATAGAGG
AGACCCTGGCTCATTTCCACCTCACCAAAGACATGCTGCTGGAGGTGAAGAAGAGGATGCGGGCCGAGAT
GGAGCTGGGGCTGAGGAAGCAGACGCACAACAATGCCGTGGTTAAGATGCTGCCCTCCTTCGTCCGGAGA
ACTCCCGACGGGACCGAGAATGGTGACTTCTTGGCCCTGGATCTTGGAGGAACCAATTTCCGTGTGCTGC
TGGTGAAAATCCGTAGTGGGAAAAAGAGAACGGTGGAAATGCACAACAAGATCTACGCCATTCCTATTGA
AATCATGCAGGGCACTGGGGAAGAGCTGTTTGATCACATTGTCTCCTGCATCTCTGACTTCTTGGACTAC
ATGGGGATCAAAGGCCCCAGGATGCCTCTGGGCTTCACGTTCTCATTTCCCTGCCAGCAGACGAGTCTGG
ACGCGGGAATCTTGATCACGTGGACAAAGGGTTTTAAGGCAACAGACTGCGTGGGCCACGATGTAGTCAC
CTTACTAAGGGATGCGATAAAAAGGAGAGAGGAATTTGACCTGGACGTGGTGGCTGTGGTCAACGACACA
GTGGGCACCATGATGACCTGTGCTTATGAGGAGCCCACCTGTGAGGTTGGACTCATTGTTGGGACCGGCA
GCAATGCCTGCTACATGGAGGAGATGAAGAACGTGGAGATGGTGGAGGGGGACCAGGGGCAGATGTGCAT
CAACATGGAGTGGGGGGCCTTTGGGGACAACGGGTGTCTGGATGATATCAGGACACACTACGACAGACTG
GTGGACGAATATTCCCTAAATGCTGGGAAACAAAGGTATGAGAAGATGATCAGTGGTATGTACCTGGGTG
AAATCGTCCGCAACATCTTAATCGACTTCACCAAGAAGGGATTCCTCTTCCGAGGGCAGATCTCTGAGAC
GCTGAAGACCCGGGGCATCTTTGAGACCAAGTTTCTCTCTCAGATCGAGAGTGACCGATTAGCACTGCTC
CAGGTCCGGGCTATCCTCCAGCAGCTAGGTCTGAATAGCACCTGCGATGACAGTATCCTCGTCAAGACAG
TGTGCGGGTGGTGTCCAGGAGGGCCGCACAGCTGTGTGGCGCAGGCATGGCTGCGGTTGTGGATAAGAT
CCGCGAGAACAGAGGACTGGACCGTCTGAATGTGACTGTGGGAGTGGACGGGACACTCTACAAGCTTCAT
CCACACTTCTCCAGAATCATGCACCAGACGGTGAAGGAACTGTCACCAAAATGTAACGTGTCCTTCCTCC
TGTCTGAGGATGGCAGCGGCAAGGGGGCCGCCCTCATCACGGCCGTGGGCGTGCGGTTACGCACAGAGGC
AAGCAGCTAAGAGTCCGGATCCCCAGCCTACTGCCTCTCCAGCACTTCTCTCTTCAAGCGGCGACCCCC
TACCCTCCCAGCGAGTTGCGCTGGGAGACGCTGGCGCCAGGGCCTGCCGGCGCGGGGAGGAAAGCAAAT
CCAACTAATGGTATATATTGTAGGGTACAGAATAGAGCGTGTGCTGTTGATAATATCTCTCACCCGGATC
CCTCCTCACTTGCCCTGCCACTTTGCATGGTTTGATTTTGACCTGGTCCCCCACGTGTGAAGTGTAGTGG
```

Figure 20 (Continued)

```
CATCCATTTCTAATGTATGCATTCATCCAACAGAGTTATTTATTGGCTGGAGATGGAAAATCACACCACC
TGACAGGCCTTCTGGGCCTCCAAAGCCCATCCTTGGGGTTCCCCCTCCCTGTGTGAAATGTATTATCACC
AGCAGACACTGCCGGGCCTCCCTCCCGGGGGCACTGCCTGAAGGCGAGTGTGGGCATAGCATTAGCTGCT
TCCTCCCCTCCTGGCACCCACTGTGGCCTGGCATCGCATCGTGGTGTGTCAATGCCACAAAATCGTGTGT
CCGTGGAACCAGTCCTAGCCGCGTGTGACAGTCTTGCATTCTGTTTGTCTCGTGGGGGAGGTGGACAGT
CCTGCGGAAATGTGTCTTGTCTCCATTTGGATAAAAGGAACCAACCAACAAACAATGCCATCACTGGAAT
TTCCCACCGCTTTGTGAGCCGTGTCGTATGACCTAGTAAACTTTGTACCAATTCAAAAAAAAAAAAAAA
AA

>gi|16307124|gb|BC009650.1| Homo sapiens PDS5, regulator of cohesion maintenance,
homolog A (S. cerevisiae), mRNA (cDNA clone IMAGE:3461329), partial cds
ATCCTGTGAAGGAGAGAAGAGCACACGCACGACAATGTTTACTGAAAAATATCAGTATACGCAGGGAATA
CATTAAGCAGAATCCTATGGCTACTGAGAAATTATTATCACTGTTGCCTGAATATGTAGTTCCATACATG
ATTCACCTGCTAGCCCATGATCCAGATTTTACAAGATCACAAGATGTTGATCAGCTTCGTGATATCAAAG
AGTGCCTATGGTTCATGCTTGAAGTTTTAATGACAAAGAATGAAAACAATAGCCATGCCTTTATGAAGAA
GATGGCAGAGAACATCAAGTTAACCAGAGATGCCCAGTCTCCAGATGAATCCAAGACAAATGAAAAACTG
TATACAGTATGTGATGTGGCTCTCTGTGTTATAAATAGTAAAAGTGCTTTGTGCAATGCAGATTCACCAA
AGGACCCAGTCCTCCCAATGAAATTTTTTACACAACCTGAAAAGGACTTCTGTAACGATAAGAGTTATAT
TTCAGAAGAGACAAGAGTACTTCTGTTAACAGGAAAGCCAAAGCCTGCTGGAGTACTAGGTGCAGTAAAT
AAGCCTTTATCAGCAACGGGAAGGAAACCCTATGTTAGAAGCACTGGCACTGAGACTGGAAGCAATATTA
ATGTAAATTCAGAGCTGAACCCTTCAACCGGAAATCGATCAAGGGAACAGAGTTCAGAGGCAGCAGAAAC
TGGAGTTAGTGAAAATGAAGAGAACCCTGTGAGGATTATTTCAGTCACACCTGTAAAGAATATTGACCCA
GTAAAGAATAAGGAAATTAATTCTGATCAGGCTACCCAGGGCAACATCAGCAGTGACCGAGGAAAGAAAA
GAACAGTAACAGCAGCTGGTGCAGAGAATATCCAACAAAAAACAGATGAGAAAGTAGATGAATCGGGACC
TCCCGCCCCTTCCAAACCCAGGAGAGGACGTCGACCCAAGTCTGAATCTCAGGGCAATGCTACCAAAAAT
GATGATCTAAATAAACCTATTAACAAGGGAAGGAAGAGAGCTGCAGTGGGTCAGGAGAGCCCTGGGGGTT
TGGAAGCAGGTAATGCCAAAGCACCCAAACTGCAAGATTTAGCCAAAAAGGCAGCACCAGCAGAAAGACA
AATTGACTTACAAAGGTAAAAATGCATTTGCAAAGGGAGAAAATGAAGGCCAAACAGAAGCAGGCTCCAG
CTTCTGCAAAAACTTGGATTCACAAATGTCCCTGAACAGAAAATGAAGCTCACTTCAGAACACACACTCT
CTGCCTTGAAAACTAAAGAGACTATTACTTCCTTTTCACATGACCACAAGTCCTCTGATGGAAATGTACA
GCAGAAACTCTTGAGAGAGAGGCTAAAAGCAACTCTGTTCTCCCCCTTCCCCTAGACTTTTCTTACGAAA
AGTCAATAATTAAGCAAATTGCTTAACACTTGGTTCCAGTTCCTGCCTATCTGGAGTTTAAATGCGTAAT
ACACCATTAATTTCCACGCTGCAGTTTTTATTTTAAAGAAAGTAACAAGATGTCTTTACACTGACACTGA
AAATTCATCCATTTTAGAGCCAGGAATTCCCATGTTACACAGGAAAAAATAGAAGTCTACTGAATTAATT
TTTTAAAAGAAAAGAGATCAGATTAAATATTTCTTTGTTTTTCCTTTTGGAAACTTTTATGTATAATTCT
TTCTGCCTGCCTACTTTTCTGCAAAAATGAGATGTACAGATTTCGGTTCCCTGCTATGAAAAGTGATGTG
GTAGCAATTTTATAAATGTTGCTTTCTGATTTTTATCAGAGTGAGAAAATTAAAATTATTGATTTGCAAG
TAGTAAACAGTTCATATTTTGATTTCCCCTCATTTTAGTTTAATATAATTTGCAATAAATGTACATATTG
TTGTTTGTTTCATAAAGCATATCACTTTAAAATGGTTTTTACTCCTGTGATTATGTTGGAATATTTGGAA
TTTTAAAGGAGTAAAGACTGTCCAGCATTTGGTTTTATAATGTTTGTCACCAGATTTTTATTAATGTAAA
AAAAATCAATTTTTAAAAAATAGTTGGACTTTGGCAGCTTTTAAGGAAAGTTGGAGGTGTTTTAGGATTG
CTATCAATTTTCAGCATTGTGCTATTTGGAAATAAGTGTTTTGCTTTTGTCTGATGGTCTGGGCTCATTT
```

Figure 20 (Continued)

```
TTATGTTTATTTTAGAAAACTGTTGCATCAATATATTATGTTTCTTGGCATTGTTCAGCATAGGTAATGT
GTGCACTTTATGTGTACACATAATCATATTTAAGTTTTTTGCATAAAATAAATGCTTCTAGATGTCATGG
CAGTCTTTTTAATCTTTTTATCATATGCTTTCTTGTGAATTTTTTCATGTTAAAGAGCTAAAGTCATAAC
ATGATTACAGTCAACTCTCCATTATCTATATAAAATAGTGACTAAGCCTCAGGTTTTTAATTTTGTGATA
ACAAAATAACGAAGGCATGTAAGACCTGATTCTGGAGGAACATGAAATTTGTCTTTTCTCATGTCCAGAG
TTCTATCCTGCCCCCACTGTCCACTGTAGGGTCATCCGCAAAGCCCTAGCAGAATGTGCTCACTCCATTT
CCTTACACGTTTCTAGCATGGGTCAGAGGAAACAACATTTGTGTTATAACTTCGTCTTGATAGGCTGTAG
TGTACATGGGATGTAAAACAAACAAGTGTATCAAAGGTGGATGATTCTGTTAGAGTGAAGTTTGAGAGTA
AATGTCACTTACGTTTCTCATAGATAATCAAGAGTTGGCTGTGTATTGACTGAAAGATGGGTAATTATTT
TAAATATGCATTTACACACATTTAGGTATCAGAAGATGCTTAGGGAACAATGGATACCAATGATAGAAAA
TGATACCTTTACAGGGGCAGAAAAATCCCCACTCTTCCTTATTGCCTCTTCAGAACCCTTTAGAAAGTAT
AAAATATTGCCTCCAACATGCTGAAAAGAGTATCTATGCATAAGTATCAGAGAAGTCCCTCAAGCAATC
AGTAGGTGTGTTCTATTTAGAGAGAGTTTAAAGTTCTCTTAGCATCAGACAACTTGATTCCTAAGGTTTC
CAGTGTGTCACCAACAAAAAGTGCATTGATAGGGACCTTTGTCTCTTCCTCCCTTTGATTAATTGCCCGG
CATCACAGTTTACTAGATTACCAAGTGTTACATCATATTAAATAAAATGTAGCAGAACCATCTGCATCAA
TATATTCCTGTTTAGATTTTTGCAGGAGAGAAGTTAAAAGGATTTGCTCCTTGTATGATGTAAGTGGCCC
ACCCCAATTTTGTAACATGATGCAAGTGTCTGGCACTAAGGGAAGCAAGAGTAGGGTTGTGGAAAGACCA
AGCTGATGGGAGGGACTTGTTTACGGGAATTTTTTAGTTTTCCTTTTCAAAGGAAAACATTAAAATCC
CTTAGGAATTTGGTATTCACATCTCAGAGAACTACAACACAAAAGTGCAGACTTATATTTGAGAATTAAT
GTTAACCCTTTGTGTCTAGTTTGAAGCTTCTTGTATTTGTCTAAAACAACAAGCCAGAATTTTGTATCTC
CTTTGATAAAAAGTGTGTATAATGTAAAGTAGTTTTGCATATTCTTGTGCTGCACATGGGCTGAATTTTT
AAATTTTTTTAAAAACTTGAAGCAGAACCTTGTAATTTGTGTAAATGACAAGTGTAAAATCCTACCATA
AAATGCTAAAAATATGCACTGTTTCAAATAAAACCAAGAAATGCAGCATTAAAAAAAAAAAAAAAAAAA

>gi|39644878|gb|BC009967.2| Homo sapiens SCY1-like 1 (S. cerevisiae), mRNA (cDNA
clone IMAGE:4299750), partial cds
GTCGGCACAAGGTGCTGCCCCAGCTGCTGACCGCCTTCGAGTTCGGCAATGCTGGGGCCGTTGTCCTCAC
GCCCCTCTTCAAGGTGGGCAAGTTCCTGAGCGCTGAGGAGTATCAGCAGAAGATCATCCCTGTGGTGGTC
AAGATGTTCTCATCCACTGACCGGGCCATGCGCATCCGCCTCCTGCAGCAGATGGAGCAGTTCATCCAGT
ACCTTGACGAGCCAACAGTCAACACCCAGATCTTCCCCCACGTCGTACATGGCTTCCTGGACACCAACCC
TGCCATCCGGGAGCAGACGGTCAAGTCCATGCTGCTCCTGGCCCCAAAGCTGAACGAGGCCAACCTCAAT
GTGGAGCTGATGAAGCACTTTGCACGGCTACAGGCCAAGGATGAACAGGGCCCCATCCGCTGCAACACCA
CAGTCTGCCTGGGCAAAATCGGCTCCTACCTCAGTGCTAGCACCAGACACAGGGTCCTTACCTCTGCCTT
CAGCCGAGCCACTAGGGACCCGTTTGCACCGTCCCGGGTTGCGGGTGTCCTGGGCTTTGCTGCCACCCAC
AACCTCTACTCAATGAACGACTGTGCCCAGAAGATCCTGCCTGTGCTCTGCGGTCTCACTGTAGATCCTG
AGAAATCCGTGCGAGACCAGGCCTTCAAGGCCATTCGGAGCTTCCTGTCCAAATTGGAGTCTGTGTCGGA
GGACCCGACCCAGCTGGAGGAAGTGGAGAAGGATGTCCATGCAGCCTCCAGCCCTGGCATGGGAGGAGCC
GCAGCTAGCTGGGCAGGCTGGGCCGTGACCGGGGTCTCCTCACTCACCTCCAAGCTGATCCGTTCGCACC
CAACCACTGCCCCAACAGAAACCAACATTCCCCAAAGACCCACGCCTGAAGGAGTTCCTGCCCCAGCCCC
CACCCCTGTTCCTGCCACCCCTACAACCTCAGGCCACTGGGAGACGCAGGAGGAGGACAAGGACACAGCA
GAGGACAGCAGCACTGCTGACAGATGGACGACGAAGACTGGGGCAGCCTGGAGCAGGAGGCCGAGTCTG
TGCTGGCCCAGCAGGACGACTGGAGCACCGGGGGCCAAGTGAGCCGTGCTAGTCAGGTCAGCAACTCCGA
```

Figure 20 (Continued)

```
CCACAAATCCTCCAAATCCCCAGAGTCCGACTGGAGCAGCTGGGAAGCTGAGGGCTCCTGGGAACAGGGC
TGGCAGGAGCCAAGCTCCCAGGAGCCACCTCCTGACGGTACACGGCTGGCCAGCGAGTATAACTGGGGTG
GCCCAGAGTCCAGCGACAAGGGCGACCCCTTCGCTACCCTGTCTGCACGTCCCAGCACCCAGGACAGGTC
AAGGCTGAGCTGGCCCGGAAGAAGCGCGAGGAGCGGCGGCGGGAGATGGAGGCCAAACGCGCCGAGAGGA
AGGTGGCCAAGGGCCCCATGAAGCTGGGAGCCCGGAAGCTGGACTGAACCGTGGCGGTGGCCCTTCCCGG
CTGCGGAGAGCCCGCCCCACAGATGTATTTATTGTACAAACCATGTGAGCCCGGCCGGCCCAGCCAGGCC
ATCTCACGTGTACATAATCAGAGCCACAATAAATTCTATTTCACAAAAAAAAAAAAAAAAAAAAAAAAAA
AAAAAAAAAAAAAAAAAAAAAAAAAA

>gi|33874812|gb|BC009993.2| Homo sapiens chromosome 3 open reading frame 37, mRNA
(cDNA clone MGC:16741 IMAGE:4130099), complete cds
ACGCGAGCTGACTGAGGGCCGGAGCGGAGCGAGGCGACGCGGGGAGGGGCGAGGGATCGCGGCCGGTGGC
TGGGGGCCACCTGCTCCCCGAGCACCGGCCCCGCTCCGGGGAGCAGAGTCCGGAGCGGGATCCGCGGCC
CACAGGTTGCGAGGGGCGGTGTTGAAGAATGTGTGGGCGAACATCCTGTCACTTACCTAGAGATGTTCTC
ACGAGAGCTTGCGCCTACCAGGATCGGCGGGGCCAGCAGCGGCTCCCGGAGTGGAGGGACCCTGATAAGT
ACTGCCCCTCTTACAACAAGAGTCCTCAATCCAACAGCCCAGTGCTTCTGTCTCGACTGCACTTTGATAA
GGATGCAGACTCATCTGAGCGTATCATTGCTCCCATGCGCTGGGGCTTGGTCCCTTCTTGGTTCAAAGAA
AGTGATCCTTCCAAGCTGCAGTTCAATACTACCAACTGTCGTAGTGATACCGTAATGGAGAAACGGTCAT
TTAAGGTGCCTCTGGGAAAGGGAAGACGCTGTGTCGTTTTAGCAGATGGATTCTATGAGTGGCAGCGATG
TCAGGGAACAAACCAGAGGCAGCCATACTTCATCTATTTTCCTCAAATCAAGACAGAGAAGTCAGGTAGC
ATTGGTGCTGCAGATAGTCCTGAGAACTGGGAGAAAGTCTGGGACAACTGGAGGCTGCTGACAATGGCCG
GGATCTTTGACTGCTGGGAGCCCCAGAGGGAGGAGATGTCCTGTATTCCTATACCATCATCACAGTGGA
TTCCTGCAAAGGCTTGAGTGACATCCACCACAGGATGCCTGCCATATTAGATGGAGAGGAGGCAGTTTCT
AAATGGCTTGACTTTGGTGAAGTCTCAACTCAGGAAGCTCTGAAATTAATCCACCCAACAGAGAACATCA
CCTTCCATGCAGTCTCTTCTGTGGTGAACAACTCGCGAAACAACACTCCTGAGTGTCTGGCTCCTGTCGA
CTTGGTGGTCAAAAAGGAGCTCAGGGCAAGTGGCAGTAGCCAGAGGATGTTGCAGTGGTTGGCCACAAAG
TCACCCAAAAAGGAAGACTCAAAAACACCTCAAAAGGAAGAGTCAGATGTTCCCCAGTGGTCCAGTCAGT
TCCTGCAGAAGAGTCCACTCCCCACCAAGAGAGGCACTGCAGGACTCCTAGAGCAATGGCTGAAGCGGGA
GAAGGAGGAGGAACCTGTGGCCAAGCGTCCTTACAGCCAGTGACACAGGACTTTCAGAGACCAAGGCCAG
GGTCTGCTGCACTGCTGTTCTGATAATAGGTTCTTAACATTGTATGTATATGTGTTTGCTTTGGGAGGAG
GTGGCACTGTGTTAGTTGACAGTTGTGGGCTCATGTAGTCTTTTTTGCCATGAGTAGGAGCCCCTAGTGG
GGCTGGTGGACAGCTTTGGAAGAGGTGTCCTGCTGCTGTTACCAGCCATGTGGGCCCCATAGGGCACTG
CGCCTGCTGCCCTTTCCTGGCAGGGCTGGTGGAGTCTTCCCTCAAAGCATGCCTTACCCAGCTGGGAAGT
CTCTGCCCTGATCTGGTACTCCTTGTAGTAAGCTGTTTTCTGCTCAGCCACTGGGCTCTTTCACTTTTTT
AGTTCTTAAAAATTTATTTTTAAGTTCTAAAATAAAATAAAAATAAGTTCTTAAAATTTATTTTTTCCT
GAATAAATTGTATTTGGTAAACTTCTGCCTAAAAAAAAAAAAAAAAAAA >gi|15029992|gb|BC011234.1| Homo sapiens survival motor neuron domain containing
1, mRNA (cDNA clone MGC:17138 IMAGE:4153336), complete cds
CCTCCTTCCAGTGCCCGGCGTTCCTCCCTTCCCCCTCGCCGCCGACCGAGTTCTTCCTTTTCAGACCGGG
TCGCCTTGCTGTCGTCGCGGTGATTTTCCTGCTACTGCTACTGCTGCTGCTGCCACCGCCACTACCACTG
GGCTCATTTGCCCCGACCCCTTCCCGCCGCCCCGCCCCAGCCCCACACAAGATGTCAGAGGATTTAGCA
```

Figure 20 (Continued)

```
AAGCAGCTGGCAAGCTACAAAGCTCAGCTCCAGCAAGTTGAAGCTGCATTATCTGGAAATGGAGAAAATG
AAGATTTGCTAAAATTGAAGAAAGATTTACAAGAAGTTATAGAACTAACCAAAGACCTTCTGTCAACTCA
ACCTTCTGAGACGCTTGCAAGTTCAGACAGTTTTGCTTCTACTCAACCTACTCATTCATGGAAAGTAGGA
GACAAGTGTATGGCAGTCTGGAGTGAAGATGGACAGTGTTATGAAGCGGAGATTGAGGAGATAGATGAAG
AAAATGGCACCGCTGCAATCACCTTTGCTGGTTATGGCAATGCTGAAGTGACTCCACTGTTGAACCTCAA
GCCTGTAGAAGAAGGAAGGAAGGCAAAGGAGGACAGTGGCAACAAACCCATGTCAAAAAAAGAAATGATT
GCCCAGCAGCGTGAATATAAAAAGAAGAAAGCTTTGAAAAAAGCTCAGAGAATAAAAGAACTTGAGCAGG
AAAGAGAGGACCAGAAAGTGAAATGGCAACAATTCAACAACAGAGCCTATTCTAAAAACAAAAAAGGCCA
GGTAAAGAGGAGTATTTTTGCTTCACCTGAGAGTGTGACTGGTAAAGTTGGAGTAGGAACCTGTGGAATT
GCTGATAAACCTATGACACAATATCAAGATACCTCTAAATACAATGTCAGGCATTTGATGCCTCAATAAT
CAGAAAAACTGTTGGATTTCATCTCTGCAGGGCTTTACATTTACCTTTTTATCCTTATATTTTTCTAAAG
GTAAATTATTTGTTAGATGAGTAAGCAAGATACCATTGTCGTCATTGGTTGGCTTCAGTAGAATGAAACG
TGAAGAAATTGCATTTGATAACTGCTATTCATTTAACTTTTCTCATTATCAGTACCACGGTTCCCTCAAA
GTTTGTTGAATAAAGCAACTTTTGTAGATGCTGTTTCATACAGCACTTAGATGAATTATTGATCTTCCTA
ATATCAGGCGCCTACTTAACCTATGGTGTGTACTTTTTGTAAGTTGTAACTTGAAATTTTCAGATGCTTT
GAACTTGACACATACTCTAGCAATTCATTGGAACACCAAGGCAAAAACACCAACCTGCTAAAAGAGATCT
TTTCATTTTTCTTATTTTCAGCTTTAAAACTTAGCTGTCGTTCAGTTAAGCTTAAAGATAGGTTAATTTG
TAAATGGCAAAGTTTGTTTTGAGGTTTTTCCTCAATAACTTGTTTCCCAGGCCTATTAGGCCATCTCTAA
AATTGATCTAGCTGTTTTATTTTTATGTACTCTTAGTTTTATGTAAGAAACCTTAGGATGAGCTCCCTTT
TCTAAGGTGTTTTTGTTTTTTGTATGTTTGCTTTTTTCCTGTTTTTTGTTTTTTCCATTTACGGCAGTGG
TACCATGTTTTGGATGTGTGATGTTTATATGGGAGAACAAAAAGCTGATGTATAGCCCTGTATACAGTGT
AGATACTATTTTTGTAAAAACACAAGGCTAAATTAATGAACAAGAATACTGAATATTTCATCATTAAAAA
TTTCTTGTATTTCTTGTGCATTAATCTGACGATAATTTCCCTGTATATTATGTTCATTTAGCTGTTTGTA
ATTTTTGTTAATTAGATCAGGTTGTCTGCATTTGTTGGTGTAAGTGAACATCATCACAGTTATCCTGAGT
TGAGTTTAAGCCAAATACATGCATAGAAAAGGGTCTTCCTATTAATGGAAGAAGGTAATTTTTAGGATGT
GTATTATTTCAGTTTTGTATGTTTAACTTTTATTAAATAAAGTGTTTTTAAAATCTCCAAAAAAAAAAAA
AAA

>gi|92443543|gb|BC011600.2| Homo sapiens cDNA clone IMAGE:3050953, **** WARNING:
chimeric clone ****
GGTTGCCGCCCCCTCGGGAGCCACCATGTTGGTGATACCCCCCGGACTGAGCGAGGAAGAGGAGGCTCTG
CAGAAGAAATTCAACAAGCTCAAGAAAAAGAAAAAGGCATTGCTGGCTCTGAAGAAGCAAAGTAGCAGCA
GCACAACCAGCCAAGGTGGTGTCAAACGCTCACTATCAGAGCAGCCTGTCATGGACACAGCCACAGCAAC
AGAGCAGGCAAAGCAGCTGGTGAAGTCAGGAGCCATCAGTGCCATCAAGGCTGAGACCAAGAACTCAGGC
TTCAAGCGTTCTCGAACCCTTGAGGGGAAGTTAAAGGACCCCGAGAAGGGACCAGTCCCCACTTTCCAGC
CGTTCCAGAGGAGCATATCTGCTGATGATGACCTGCAAGAGTCATCCAGACGTCCCCAGAGGAAATCTCT
GTATGAGAGTGATCGACTTCGAGAACTAGGACCAGATGGAGAAGAGGCAGAGGGCCCAGGGGCTGGTGAT
GGTCCCCCTCGAAGCTTTGACTGGGGCTATGAAGAACGCAGTGGTGCCCACTCCTCAGCCTCCCCTCCCC
GAAGCCGCAGCCGGGACCGCAGCCATGAGAGGAACCGGGACAGAGACCGAGAGGGTCCTTTCCGCAGGTC
GGATTCATTCCCTGAACGGCGAGCCCCTAGGAAAGGGAATACTCTCTATGTATATGGAAGAACATGACA
CCCACCCTTCTCCGTGGGGCCTTCTCTCCTTTTGGAAACATCATTGACCTCTCCATGGACCCACCCAGAA
ACTGTGCCTTCGTCACCTATGAAAAGATGGAGTCAGCAGATCAGGCCGTTGCTGAGCTCAACGGGACCCA
```

Figure 20 (Continued)

```
GGTGGAGTCTGTACAGCTCAAAGTCAACATAGCCCGAAAACAGCCCATGCTGGATGCCGCTACTGGCAAG
TCTGTCTGGGGCTCCCTCGCTGTCCAGAACAGCCCTAAGGGTTGCCACCGGGACAAGAGGACCCAGATTG
TCTACAGTGATGACGTCTACAAGGAAAACCTTGTGGATGGCTTCTAGGGAACAGAGCTGGATTCCTTGTG
CCTCATATGCCCCAATGCTGGTCTCAGTAAAACACTGAGGTGGAAGCTTAAAAAAAAAGGAGCGTCTCTG
CCCGGCCTCCCCGTCTGAGAAGTGAGGAAACCCTCTGCCTGGCAACCGCCCCGTCTGAGAAGTGAGGAGC
CCCTCCGTCCGGCAGCCACCCCGTCTGGGAAGTGAGGAGCGTCTCCGCCCGGCAGCCACCCCGACCGGGA
GGGAGGTGGGGGGGGGGGGTCAGCCCCCCGCCCGGCCAGCCGCCCCGTCCGGGAGGTGAGGGGCTCCTCT
GCCCGGCCGCCCCTACTGGGAAGTGAGGAGCCCCTCTGCCCGGCCAGCCGCCCCGTCCGGGAGGGAGGTG
GGGGGATCAGCCCCCCGCCTGGCCAGCCGCCCCGTCCGGGAGGTGAGGGGCGCCTCTGCCCGGCCGCCCC
TACTGGGAAGTGAGGAGCCCCTCTGCCCGGCCAGCCGCCCCGTCCGGGAGGGAGGTGGGGGGGTCAGCCC
CCCGCCCGGCCAGCCGCCCCATCCGGGAGGGAGGTGGGGGGGTCAGCCCTCCGCCCGGCCAGCCGCCCCG
TCCGGGAGGGAGGTGGGGGGGGTCAGCCCCCCGCCCGGCCAGCCGCCCCGTCCGGGAGGGAGGTGGGGGG
ATCAGCCCCCCGCCTGGCCAGCCACCCCGTCCGGGAGGTGAGGGGCGCCTCTGCCCGGCCGCCCCTACTG
GGAAGTGAGGACCCCTCTGCCTGGCCAGCCGCCCCGTCCGGAGGGTTGGGGGGGGGTCAGCCCCCCGCC
CGGCCAGCCGCCCCATCCGGGAGGTGAGGGGCGCTTCTGCCCGGCCGCCCCTACTGGGAAATGAGGAGCC
CCTCTGCCCGGCCACGACCCCGTCTGGGAGGTGTGCCCAGCGGCTCATTGGGATGGGCCATGATGACAA
TGGCGGTTTTGTGGAATAGAAAGGCGGGAAGAGTGGGGAAAAAATTGAGAAATCGGATGGTTGCCGGGTC
TCTGTGGATAGAAGTAGACATGGGAGACTTTTCATTTTGTTCTGTACTAAGAAAAATTCTTCTGCCTTGG
GATCCTGTTGATCTGTGACCTTATCCCCAACCCTGTGCTCTCTGAAACATGTGCTGTGTCCACTCAGGGT
TAAATGGATTAAGGGCGGTGCAAGATGTGCTTTGTTAAACAGATGCTTGAAGGCAGCATGCTCGTTAAGA
GTCATCACCACTCCCTAATCTTAAGTACCCAGGGACACAAACACTGCGGAAGGCCGCAGGGTCCTCTGCC
TAGGAAAACCAGAGACCTTTGTTCACTTGTTTATCTACTGACCTTCCCTCCACTATTGTCCTATGACCCT
GCCAAATCCCCCTCTGCGAGAAACACCCAAGAATGATCAATAAAATAAATAAATAAATAAATAATA
AAAAAAAAAAAAAAAAAA

>gi|33877786|gb|BC011776.2| Homo sapiens tropomyosin 2 (beta), mRNA (cDNA clone
MGC:19587 IMAGE:3640927), complete cds
CCCAGCCCAGTCCGTCCGGTCCTCACCGCCTGCCGGCCGGCCCACCCCCCACCGCAGCCATGGACGCCAT
CAAGAAGAAGATGCAGATGCTGAAGCTGGACAAGGAGAACGCCATCGACCGCGCCGAGCAGGCCGAAGCC
GACAAGAAGCAAGCTGAGGACCGCTGCAAGCAGCTGGAGGAGGAGCAGCAGGCCCTCCAGAAGAAGCTGA
AGGGGACAGAGGATGAGGTGGAAAAGTATTCTGAATCCGTGAAGGAGGCCCAGGAGAAACTGGAGCAGGC
CGAGAAGAAGGCCACTGATGCTGAGGCAGATGTGGCCTCCCTGAACCGCCGCATTCAGCTGGTTGAGGAG
GAGCTGGACCGGGCCCAGGAGCGCCTGGCTACAGCCCTGCAGAAGCTGGAGGAGGCCGAGAAGGCGGCTG
ATGAGAGCGAGAGAGGAATGAAGGTCATCGAAAACCGGGCCATGAAGGATGAGGAGAAGATGGAACTGCA
GGAGATGCAGCTGAAGGAGGCCAAGCACATCGCTGAGGATTCAGACCGCAAATATGAAGAGGTGGCCAGG
AAGCTGGTGATCCTGGAAGGAGAGCTGGAGCGCTCGGAGGAGAGGGCTGAGGTGGCCGAGAGCCGAGCCA
GACAGCTGGAGGAGGAACTTCGAACCATGGACCAGGCCCTCAAGTCCCTGATGGCCTCAGAGGAGGAGTA
TTCCACCAAAGAAGATAAATATGAAGAGGAGATCAAACTGTTGGAGGAGAAGCTGAAGGAGGCTGAGACC
CGAGCAGAGTTTGCCGAGAGGTCTGTGGCAAAGTTGGAGAAAACCATCGATGACCTAGAAGAGACCTTGG
CCAGTGCCAAGGAGGAGAACGTCGAGATTCACCAGACCTTGGACCAGACCCTGCTGGAACTCAACAACCT
GTGAGGGCCAGCCCCACCCCCAGCCAGGCTATGGTTGCCACCCCAACCCAATAAAACTGATGTTACTAGC
CAAAAAAAAAAAAAAAAAAAAAAAAAAAAAAAAAAAAAAAAAAAAAAA
```

Figure 20 (Continued)

```
>gi|15779149|gb|BC014640.1| Homo sapiens collagen, type XIV, alpha 1, mRNA (cDNA
clone IMAGE:2960796), complete cds
GACAGGCATGGTGAAAACATTGTTCTTGGGTGTTACCAATCTCCAAGCCAAACATGTTGAAATGACCAGC
TTGTGTGCCCACTGGCAGGTACATCGCCATGCCACAGCCTATAGGGTTGTTATAGAATCCCTCCAGGATA
GGCAAAAGCAAGAATCCACTGTGGGTGGAGGGACAACCAGGCATTGCTTCTATGGACTTCAGCCTGATTC
TGAATATAAAATCAGTGTTTATACAAAGCTCCAGGAGATTGAAGGACCTAGTGTGAGCATAATGGAAAAA
ACACAATCACTTCCTACACGACCACCAACTTTTCCTCCAACCATTCCACCAGCAAAAGAAGTATGTAAGG
CGGCCAAGGCTGACCTGGTATTTATGGTGGATGGATCCTGGAGCATTGGAGATGAAAAATTTCAATAAGA
TCATCAGCTTTCTATACAGCACTGTTGGAGCCCTGAACAAGATTGGCACAGATGGAACCCAAGTTGCAAT
GGTTCAGTTCACTGATGATCCCAGAACAGAATTTAAACTAAATGCTTACAAAACCAAAGAGACTCTTCTT
GATGCAATTAAACACATTTCATACAAAGGAGGAAATACAAAAACAGGAAAAGCAATTAAGTATGTTCGAG
ATACCTTGTTCACTGCAGAGTCAGGTACAAGAAGGGGCATCCCAAAGGTTATCGTGGTTATAACTGATGG
AAGATCACAAGATGATGTGAACAAAATCTCCAGGGAGATGCAATTAGATGGCTATAGCATTTTTGCAATT
GGTGTGGCCGATGCAGATTACTCGGAGTTGGTTAGCATTGGCAGTAAGCCCAGCGCACGCCATGTCTTCT
TTGTGGATGACTTTGACGCCTTTAAGAAAATCGAAGATGAGTTAATTACTTTTGTCTGCGAAACAGCATC
AGCAACCTGTCCAGTGGTACACAAGGATGGCATTGATCTTGCAGGATTTAAGATGATGGAAATGTTTGGT
TTGGTTGAAAAAGATTTTTCATCAGTGGAAGGGGTTTCTATGGAGCCTGGTACCTTCAATGTGTTTCCAT
GTTACCAACTCCATAAAGATGCCCTGGTTTCCCAGCCAACCAGGTACTTGCACCCAGAAGGATTGCCCTC
CGACTACACAATCAGTTTTCTATTCCGGATTCTTCCTGACACTCCACAGGAGCCATTTGCTCTTTGGGAG
ATTTTAAATAAAAATTCTGACCCATTGGTTGGGGTTATTTTAGACAATGGTGGGAAAACTCTAACATATT
TCAACTATGACCAGAGTGGGGATTTTCAAACTCTTACTTTCGAAGGACCTGAAATTAGGAAAATTTTTTA
TGGAAGCTTTCACAAGCTACACATTGTTGTCAGTGAGACTTTGGTCAAAGTGGTTATTGACTGCAAGCAA
GTGGGTGAGAAGGCAATGAACGCATCAGCTAATATCACGTCAGATGGTGTAGAAGTGCTAGGGAAAATGG
TTCGATCAAGAGGACCAGGTGGAAACTCTGCACCGTTCCAGTTACAGATGTTTGATATTGTTTGCTCCAC
ATCATGGGCCAATACAGACAAATGCTGTGAACTTCCAGGCCTGAGAGATGATGAGTCTTGCCCAGACCTT
CCCCATTCCTGCTCCTGTTCTGAAACCAATGAAGTGGCTCTGGGACCAGCGGGCCCACCAGGTGGTCCAG
GACTCCGAGGACCAAAGGGCCAGCAAGGTGAACCGGGTCCAAAGGGACCAGATGGCCCTCGGGGTGAAAT
TGGTCTGCCAGGACCTCAGGGTCCACCTGGACCTCAAGGACCAAGTGGTCTGTCCATTCAAGGAATGCCC
GGAATGCCAGGAGAAAAGGAGAGAAAGGAGATACTGGCCTTCCAGGTCCACAGGGTATCCCAGGAGGCG
TTGGTTCACCAGGACGTGATGGCTCACCAGGCCAGAGGGGCCTTCGGGAAAGGATGGATCCTCGGGACC
TCCAGGACCACCAGGGCCAATAGGCATTCCTGGCACCCCTGGAGTCCCAGGGATCACAGGAAGCATGGGA
CCGCAAGGCGCCCTGGGACCACCTGGTGTCCCTGGAGCAAAGGGGGAACGAGGAGAGCGGGGTGACCTGC
AGTCTCAAGCCATGGTGAGATCAGTGGCGCGTCAAGTATGCGAACAGCTCATCCAGAGTCACATGGCCAG
GTACACTGCCATCCTCAACCAGATTCCCAGCCACTCCTCATCCATCCGGACTGTCCAAGGGCCTCCTGGG
GAGCCTGGGAGGCCAGGCTCACCTGGAGCCCCTGGTGAACAAGGACCCCAGGCACACCAGGCTTCCCCG
GAAATGCAGGCGTGCCAGGGACCCCAGGAGAACGAGGTCTAACTGGTATCAAAGGAGAAAAAGGAAATCC
AGGCGTTGGAACCCAAGGTCCAAGAGGCCCCCCTGGACCAGCAGGACCTTCAGGGGAGAGTCGGCCTGGC
AGCCCTGGGCCCCTGGCTCTCCTGGACCAAGAGGCCCACCAGGTCATCTGGGGGTTCCTGGACCCCAAG
GTCCTTCTGGCCAGCCTGGATATTGTGACCCCTCATCATGTTCTGCCTATGGTGTGAGAGCTCCCCATCC
AGATCAGCCAGAGTTCACCCCTGTCCAAGATGAGCTGGAAGCCATGGAACTGTGGGCCCTGGAGTCTGA
TAGCCTCAGGAGAAATTTGAAGACCAACTGCAAGAACTCTTAAGGAATCTTGTTTGAGAAAATGTTGTTA
```

Figure 20 (Continued)

```
TGTGGTTTGTATGCTACTTTTGGGGGGCAGGGCTCATTTCAGCAGCCTAAATCTCCTCCTTGGATAATGT
TAATATTATTATTATTATTAACAAAAAATATATATTTTTAAAAAGTTCCCTTAATCTATGACATGGTAGC
AATGATTTCCCTTTGGTGTCTTAATGGCATGTCAGATAATTTGTTTTTCCAGAGAAGAGAGCTCAAAGAG
GAATTGGGAAAAATAAATTGAACTCTGGAATCTTCTCTCTCAAGTCCTAAAATGAACAAACAGATATGAT
TGTGTTTGAGGGAAATATGTCCCTAGCAGGAAAAGAATTCAAAGAGGTTCAAAGAATATGTCACTTACTC
CTACTTGCTATAGGAATAACCTTGCTGATAAGAAAAAAAGGGACAATATTGGAGAAACTACCTCTTGTTT
AATTGATCTGTCCAACTCTGAGATCACTTGGTAACTGGTTTCATGTGTATCCAAAAATCAGCATTTGGAT
TTAAGCTTTCTGAATTTGGTAGTTTAAGAAACAGATTTAGTTTTTCAGTGGTTTTAACTCATGTGAAATA
ATGATTTTCCACCAGCTCTGATGCAAAGAGATATAATTTTAATGAACGATTTATCCAGCAGTTTGTTCCA
GGGGTTGCCTCTCCTTATCTACGGGATTACTTTGTACATGCAGATAAGTTTTCGCAAACCTATTTCCAT
TTTCTTTTGTAAGCAAATAAAACTTTAAAACAAAAAAAAAAAAAAAAAA

>gi|15928917|gb|BC014924.1| Homo sapiens kinesin family member 2C, mRNA (cDNA
clone MGC:17895 IMAGE:3909438), complete cds
GAAATTGAGGTTTCTTGGTATTGCGCGTTTCTCTTCCTTGCTGACTCTCCGAATGGCCATGGACTCGTCG
CTTCAGGCCCGCCTGTTTCCCGGTCTCGCTATCAAGATCCAACGCAGTAATGGTTTAATTCACAGTGCCA
ATGTAAGGACTGTGAACTTGGAGAAATCCTGTGTTTCAGTGGAATGGGCAGAAGGAGGTGCCACAAAGGG
CAAAGAGATTGATTTTGATGATGTGGCTGCAATAAACCCAGAACTCTTACAGCTTCTTCCCTTACATCCG
AAGGACAATCTGCCCTTGCAGGAAAATGTAACAATCCAGAAACAAAAACGGAGATCCGTCAACTCCAAAA
TTCCTGCTCCAAAAGAAAGTCTTCGAAGCCGCTCCACTCGCATGTCCACTGTCTCAGAGCTTCGCATCAC
GGCTCAGGAGAATGACATGGAGGTGGAGCTGCCTGCAGCTGCAAACTCCCGCAAGCAGTTTTCAGTTCCT
CCTGCCCCCACTAGGCCTTCCTGCCCTGCAGTGGCTGAAATACCATTGAGGATGGTCAGCGAGGAGATGG
AAGAGCAAGTCCATTCCATCCGAGGCAGCTCTTCTGCAAACCCTGTGAACTCAGTTCGGAGGAAATCATG
TCTTGTGAAGGAAGTGGAAAAAATGAAGAACAAGCGAGAAGAGAAGAAGGCCCAGAACTCTGAAATGAGA
ATGAAGAGAGCTCAGGAGTATGACAGTAGTTTTCCAAACTGGGAATTTGCCCGAATGATTAAAGAATTTC
GGGCTACTTTGGAATGTCATCCACTTACTATGACTGATCCTATCGAAGAGCACAGAATATGTGTCTGTGT
TAGGAAACGCCCACTGAATAAGCAAGAATTGGCCAAGAAAGAAATTGATGTGATTTCCATTCCTAGCAAG
TGTCTCCTCTTGGTACATGAACCCAAGTTGAAAGTGGACTTAACAAAGTATCTGGAGAACCAAGCATTCT
GCTTTGACTTTGCATTTGATGAAACAGCTTCGAATGAAGTTGTCTACAGGTTCACAGCAAGGCCACTGGT
ACAGACAATCTTTGAAGGTGGAAAAGCAACTTGTTTTGCATATGGCCAGACAGGAAGTGGCAAGACACAT
ACTATGGGCGGAGACCTCTCTGGGAAAGCCCAGAATGCATCCAAAGGGATCTATGCCATGGCCTCCCGGG
ACGTCTTCCTCCTGAAGAATCAACCCTGCTACCGGAAGTTGGGCCTGGAAGTCTATGTGACATTCTTCGA
GATCTACAATGGGAAGCTGTTTGACCTGCTCAACAAGAAGGCCAAGCTGCGCGTGCTGGAGGACGGCAAG
CAACAGGTGCAAGTGGTGGGGCTGCAGGAGCATCTGGTTAACTCTGCTGATGATGTCATCAAGATGATCG
ACATGGGCAGCGCCTGCAGAACCTCTGGGCAGACATTTGCCAACTCCAATTCCTCCCGCTCCCACGCGTG
CTTCCAAATTATTCTTCGAGCTAAAGGAGAATGCATGGCAAGTTCTCTTTGGTAGATCTGGCAGGGAAT
GAGCGAGGCGCGGACACTTCCAGTGCTGACCGGCAGACCCGCATGGAGGGCGCAGAAATCAACAAGAGTC
TCTTAGCCCTGAAGGAGTGCATCAGGGCCCTGGGACAGAACAAGGCTCACACCCCGTTCCGTGAGAGCAA
GCTGACACAGGTGCTGAGGGACTCCTTCATTGGGGAGAACTCTAGGACTTGCATGATTGCCACGATCTCA
CCAGGCATAAGCTCCTGTGAATATACTTTAAACACCCTGAGATATGCAGACAGGGTCAAGGAGCTGAGCC
CCCACAGTGGGCCCAGTGGAGAGCAGTTGATTCAAATGGAAACAGAAGAGATGGAAGCCTGCTCTAACGG
GGCGCTGATTCCAGGCAATTTATCCAAGGAAGAGGAGGAACTGTCTTCCCAGATGTCCAGCTTTAACGAA
```

Figure 20 (Continued)

GCCATGACTCAGATCAGGGAGCTGGAGGAGAAGGCTATGGAAGAGCTCAAGGAGATCATACAGCAAGGAC
CAGACTGGCTTGAGCTCTCTGAGATGACCGAGCAGCCAGACTATGACCTGGAGACCTTTGTGAACAAAGC
GGAATCTGCTCTGGCCCAGCAAGCCAAGCATTTCTCAGCCCTGCGAGATGTCATCAAGGCCTTGCGCCTG
GCCATGCAGCTGGAAGAGCAGGCTAGCAGACAAATAAGCAGCAAGAAACGGCCCCAGTGACGACTGCAAA
TAAAAATCTGTTTGGTTTGACACCCAGCCTCTTCCCTGGCCCTCCCCAGAGAACTTTGGGTACCTGGTGG
GTCTAGGCAGGGTCTGAGCTGGGACAGGTTCTGGTAAATGCCAAGTATGGGGGCATCTGGGCCCAGGGCA
GCTGGGGAGGGGGTCAGAGTGACATGGGACACTCCTTTTCTGTTCCTCAGTTGTCGCCCTCACGAGAGGA
AGGAGCTCTTAGTTACCCTTTTGTGTTGCCCTTCTTTCCATCAAGGGGAATGTTCTCAGCATAGAGCTTT
CTCCGCAGCATCCTGCCTGCGTGGACTGGCTGCTAATGGAGAGCTCCCTGGGGTTGTCCTGGCTCTGGGG
AGAGAGACGGAGCCTTTAGTACAGCTATCTGCTGGCTCTAAACCTTCTACGCCTTTGGGCCGAGCACTGA
ATGTCTTGTACTTTAAAAAAATGTTTCTGAGACCTCTTTCTACTTTACTGTCTCCCTAGAGATCCTAGAG
GATCCCTACTGTTTTCTGTTTTATGTGTTTATACATTGTATGTAACAATAAAGAGAAAAAATAAAAAAT
AAAAAAAAAAAAAAA

>gi|34189560|gb|BC015219.2| Homo sapiens RanBP-type and C3HC4-type zinc finger
containing 1, mRNA (cDNA clone MGC:17759 IMAGE:3877587), complete cds
GAAGAACTGGGGCCTCCCGGGAGGAGAGAGGGCTTTGCCTTGAAACCCGGGACGCCAGGGGCGCTCCCGC
AAGTGGGGGTCCTCCGGGACTTGGAACGCCCCGGCTGGGTGGTGTCCGGGCGTCCTTTCCCCGCTTCTTC
CCACCTCGGCTGGTCCCGTTTCCTCCTGCGCCCAGTGCGGACCTGTCTCGGCGCCCGCTGCCCTCTCACC
GCCCCACGCAGGATCCCGGCCTGGTCACCGGGCAGTGTGATGCTTCCCGACTGCCGCGGGGACAGCGAGG
CACACACAGGGCTTGGGCCGCGCCGGAGGCCACACGGCCTGGCTGAGTTGCTCCTGGTCTCCCGCCTCTC
CCAGGCGACCCGGAGGTAGCATTTCCCAGGAGGCACGGTCCCCCCAGGGGGATGGGCACAGCCACGCCA
GATGGACGAGAAGACCAAGAAAGCAGAGGAAATGGCCCTGAGCCTCACCCGAGCAGTGGCGGGCGGGGAT
GAACAGGTGGCAATGAAGTGTGCCATCTGGCTGGCAGAGCAACGGGTGCCCCTGAGTGTGCAACTGAAGC
CTGAGGTCTCCCCAACGCAGGACATCAGGCTGTGGGTGAGCGTGGAGGATGCTCAGATGCACACCGTCAC
CATCTGGCTCACAGTGCGCCCTGATATGACAGTGGCGTCTCTCAAGGACATGGTTTTTCTGGACTATGGC
TTCCCACCAGTCTTGCAGCAGTGGGTGATTGGGCAGCGGCTGGCACGAGACCAGGAGACCCTGCACTCCC
ATGGGGTGCGGCAGAATGGGGACAGTGCCTACCTCTATCTGCTGTCAGCCCGCAACACCTCCCTCAACCC
TCAGGAGCTGCAGCGGGAGCGGCAGCTGCGGATGCTGGAAGATCTGGGCTTCAAGGACCTCACGCTGCAG
CCGCGGGGCCCTCTGGAGCCAGGCCCCCCAAAGCCCGGGGTCCCCCAGGAACCCGGACGGGGGCAGCCAG
ATGCAGTGCCTGAGCCCCCACCGGTGGGCTGGCAGTGCCCCGGGTGCACCTTCATCAACAAGCCCACGCG
GCCTGGCTGTGAGATGTGCTGCCGGGCGCGCCCCGAGGCCTACCAGGTCCCCGCCTCATACCAGCCCGAC
GAGGAGGAGCGAGCGCGCCTGGCGGGCGAGGAGGAGGCGCTGCGTCAGTACCAGCAGCGGAAGCAGCAGC
AGCAGGAGGGGAACTACCTGCAGCACGTCCAGCTGGACCAGAGGAGCCTGGTGCTGAACACGGAGCCCGC
CGAGTGCCCCGTGTGCTACTCGGTGCTGGCGCCCGGCGAGGCCGTGGTGCTGCGTGAGTGTCTGCACACC
TTCTGCAGGGAGTGCCTGCAGGGCACCATCCGCAACAGCCAGGAGGCGGAGGTCTCCTGCCCCTTCATTG
ACAACACCTACTCGTGCTCGGGCAAGCTGCTGGAGAGGGAGATCAAGGCGCTCCTGACCCCTGAGGATTA
CCAGCGATTTCTAGACCTGGGCATCTCCATTGCTGAAAACCGCAGTGCCTTCAGCTACCATTGCAAGACC
CCAGATTGCAAGGGATGGTGCTTCTTTGAGGATGATGTCAATGAGTTCACCTGCCCTGTGTGTTTCCACG
TCAACTGCCTGCTCTGCAAGGCCATCCATGAGCAGATGAACTGCAAGGAGTATCAGGAGGACCTGGCCCT
GCGGGCTCAGAACGATGTGCTGCCCGGCAGACGACAGAGATGCTGAAGGTGATGCTGCAGCAGGGCGAG
GCCATGCGCTGCCCCCAGTGCCAGATCGTGGTACAGAAGAAGGACGGCTGCGACTGGATCCGCTGCACCG

Figure 20 (Continued)

```
TCTGCCACACCGAGATCTGCTGGGTCACCAAGGGCCCACGCTGGGGCCCTGGGGGCCCAGGAGACACCAG
CGGGGGCTGCCGCTGCAGGGTAAATGGGATTCCTTGCCACCCAAGCTGTCAGAACTGCCACTGAGCTAAA
GATGGTGGGGCCACATGCTGACCCAGCCCCACATCCACATTCTGTTAGAATGTAGCTCAGGGAGCTTCGT
GGACGGCCTTGCTTGCTGTAGCGTTGTAGGGGCCCTGCCTGCACTGCGGTTGTCCACGGTCACATCTGCC
CCAGTGCCTTTGTCCTTCCCTTGGGGCTTGCCGGCCAGACTTCTCTCCCCTGCGGCTCCCACCTCTGCCT
GACCCCAGCCTTAAACATAGCCCCTGGCCAGAGGCCTTGCTGGGTGGAGCCTCTGTGTGACTCCATACTC
CTCCCACCACAACACTCATCTGTCAAACACCAAGCACTCTCAGCCTCCCCGCCTTCAGCTGTCAGCTTTC
TGGGGCTAACTTCTCTGCCTTTGTGGTTGGAGGCCTGAGGCCTCTTGGAACTCTTGCTAACCTGTTCAGA
GCCAGGAAGGAGACTGCACAGTTTTGAAAGCACAGCCCGTCAGGTCCGGCTCTGCGTCTCCCTCTCTGCA
GCCTGTGTAAGCTATTATAATTAAAATGGTTTTCCGGGAAAAAAAAAAAAAAAAAAAAAAAAAAAAAAAA
AAAAAAAAAAAAAAAAAAAAAAAAAAAAAAAAAAAAAAAAAAAAAAAAAAAAAAAAAAAAA

>gi|34784791|gb|BC015596.2| Homo sapiens family with sequence similarity 165,
member B, mRNA (cDNA clone MGC:23362 IMAGE:4647871), complete cds
GTCGTGGTTTGTGCGCGGCCAGGCGCTGGAGCCTCCGCTGCCGGGAGCAATCAGACCTTCCAGCTGCCTC
TCATGTACTTGTCTGTTGGGGGCTTGTGTTGATCAGGAGTGAATTCACAGTCTACCATGAATTGGAAGGT
TCTTGAGCACGTGCCCCTGCTGCTGTATATCTTGGCAGCAAAAACATTAATTCTCTGCCTGACATTTGCT
GGGGTGAAAATGTATCAAAGAAAAAGGTTGGAGGCAAAACAACAAAAACTGGAGGCTGAAAGGAAGAAGC
AATCAGAGAAAAAGATAACTGAAGATTCTGCCATGTAAATGTCAGCTTGAGTGGACTCCAGCTGAGAAG
AAAGAGAAGAAAGACTTAATTATTGAATAATTTGTCAGAGGATAAACTCCCAACCTAGACCTTTCACTTA
AAATAGTGTGAATTTGTATATGTTTTTAAAAGAACCAGTACTGGCCGGGTATGCTGGCTTTTACCTGAAA
TCCCAGCACTTTGGGAGGCCGAGGCGAGTGGATCGCCTGAGATCGGGAGTTTGAGACCAGCCTGGCCAAC
ATGGTAAAATCCTGTCTCTACTAAAAATATAAAAATTAGCCAGGTGTAGTGGCGCGCGTCTGTAATCCCA
GCTACTCGGGAGGCTGAGGCAGGAGAATTGCTTGAATCCGGGAGGTGGAGGTTGCAGTGAGCCTAGGTCG
TGCCACTGCCCTCCAGCCTGGGTGACAGAGCGACTGCGTCTCCAAAAAAAAAAAGGTAAAATTAAAATTA
AAAAAAATAATAATAACCAGTATTTTGTTTACTAAAATAAAATGCCTTTGTAAAAAAAAAAAAAAAAAA >gi|16198352|gb|BC015818.1| Homo sapiens lectin, galactoside-binding, soluble, 8,
mRNA (cDNA clone MGC:13507 IMAGE:4080313), complete cds
GGGGAAACAACCTGCTCCGTGGAGCGCCTGAAACACCAGTCTTTGGGGCCAGTGCCTCAGTTTCAATCCA
GGTAACCTTTAAATGAAACTTGCCTAAAATCTTAGGTCATACACAGAAGAGACTCCAATCGACAAGAAGC
TGGAAAAGAATGATGTTGTCCTTAAACAACCTACAGAATATCATCTATAACCCGGTAATCCCGTATGTTG
GCACCATTCCCGATCAGCTGGATCCTGGAACTTTGATTGTGATATGTGGGCATGTTCCTAGTGACGCAGA
CAGATTCCAGGTGGATCTGCAGAATGGCAGCAGTGTGAAACCTCGAGCCGATGTGGCCTTTCATTTCAAT
CCTCGTTTCAAAAGGGCCGGCTGCATTGTTTGCAATACTTTGATAAATGAAAAATGGGGACGGGAAGAGA
TCACCTATGACACGCCTTTCAAAAGAGAAAAGTCTTTTGAGATCGTGATTATGGTGCTAAAGGACAAATT
CCAGGTGGCTGTAAATGGAAAACATACTCTGCTCTATGGCCACAGGATCGGCCCAGAGAAAATAGACACT
CTGGGCATTTATGGCAAAGTGAATATTCACTCAATTGGTTTTAGCTTCAGCTCGGACTTACAAAGTACCC
AAGCATCTAGTCTGGAACTGACAGAGATAAGTAGAGAAAATGTTCCAAAGTCTGGCACGCCCCAGCTTCC
TAGTAATAGAGGAGGAGACATTTCTAAAATCGCACCCAGAACTGTCTACACCAAGAGCAAAGATTCGACT
GTCAATCACACTTTGACTTGCACCAAAATACCACCTATGAACTATGTGTCAAAGAGCCTGCCATTCGCTG
CAAGGTTGAACACCCCCATGGGCCCTGGACGAACTGTCGTCGTTAAAGGAGAAGTGAATGCAAATGCCAA
```

Figure 20 (Continued)

AAGCTTTAATGTTGACCTACTAGCAGGAAAATCAAAGGATATTGCTCTACACTTGAACCCACGCCTGAAT
ATTAAAGCATTTGTAAGAAATTCTTTTCTTCAGGAGTCCTGGGGAGAAGAAGAGAGAAATATTACCTCTT
TCCCATTTAGTCCTGGGATGTACTTTGAGATGATAATTTACTGTGATGTTAGAGAATTCAAGGTTGCAGT
AAATGGCGTACACAGCCTGGAGTACAAACACAGATTTAAAGAGCTCAGCAGTATTGACACGCTGGAAATT
AATGGAGACATCCACTTACTGGAAGTAAGGAGCTGGTAGCCTACCTACACAGCTGCTACAAAAACCAAAA
TACAGAATGGCTTCTGTGATACTGGCCTTGCAAAAAAAAAAAAAAAAAAAAAAAAAAAAAA

>gi|16741668|gb|BC016634.1| Homo sapiens glutaminyl-tRNA synthetase, mRNA (cDNA
clone IMAGE:3925061), partial cds
GCTTGGCCTCCCGACTCAGGGATACCCGGCGTCTCTCCTTCCTTGTAAGCTACATAGCCAGTAAGAAGAT
CCACACTGAGCCCCAGCTAAGCGCTGCCCTTGAGTATGTGCGGAGTCACCCCTTGGACCCCATCGACACT
GTGGACTTCGAGCGGGAATGTGGCGTGGGTGTCATTGTGACCCCAGAGCAGATTGAGGAGGCTGTGGAGG
CTGCTATTAACAGGCACCGGCCCCAGCTCCTGGTGGAACGTTACCATTTCAACATGGGGCTGCTGATGGG
AGAGGCTCGGGCTGTGCTGAAGTGGGCAGATGGCAAAATGATCAAGAATGAAGTGGACATGCAGGTCCTC
CACCTTCTGGGCCCCAAGTTGGAGGCTGATCTGGAGAAGAAGTTCAAGGTGGCAAAAGCTCGGCTAGAAG
AAACAGACCGGAGGACGGCAAAGGATGTGGTGGAGAATGGCGAGACTGCTGACCAGACCCTGTCTCTGAT
GGAGCAGCTCCGGGGGGAGGCCCTTAAGTTCCACAAGCCTGGTGAGAACTACAAGACCCCAGGCTATGTG
GTCACTCCACACACCATGAATCTACTAAAGCAGCACCTGGAGATTACTGGTGGGCAGGTACGTACCCGGT
TCCCGCCAGAACCCAATGGAATCCTGCATATTGGACATGCCAAAGCCATCAGTTTCAACTTTGGCTATGC
CAAGGCCAACAATGGCATCTGTTTTCTGCGTTTTGATGACACCAACCCTGAGAAGGAGGAAGCAAAGTTC
TTCACGGCCATCTGTGACATGGTAGCCTGGCTAGGCTACACACCTTACAAAGTCACATATGCGTCTGACT
ATTTTGACCAGCTATATGCGTGGGCTGTGGAGCTCATCCGCAGGGGTCTGGCTTATGTGTGCCACCAGCG
AGGAGAGGAGCTCAAAGGCCATAATACTCTGCCTTCACCCTGGAGAGACCGTCCCATGGAGGAGTCACTG
CTGCTCTTTGAGGCAATGCGCAAGGGCAAGTTTTCAGAGGGCGAGGCCACACTACGGATGAAGCTGGTGA
TGGAGGATGGCAAGATGGACCCTGTAGCCTATCGAGTCAAGTATACACCACACCACCGCACAGGGGACAA
ATGGTGCATCTATCCCACCTACGACTACACACACTGCCTCTGTGACTCCATCGAGCACATCACTCACTCA
CTCTGCACCAAGGAATTCCAGGCCCGACGCTCTTCCTACTTCTGGCTTTGCAATGCACTGGACGTCTATT
GCCCTGTGCAGTGGGAGTATGGCCGCCTCAACCTGCACTATGCTGTTGTCTCTAAGAGGAAGATCCTCCA
GCTTGTAGCAACTGGTGCTGTGCGGGACTGGGATGACCCACGGCTCTTTACACTCACGGCCCTGCGACGG
CGGGGCTTCCCACCTGAGGCCATCAACAACTTCTGTGCCCGGGTGGGAGTGACTGTGGCACAAACCACAA
TGGAGCCACATCTTCTAGAAGCCTGTGTGCGTGATGTGCTGAATGACACAGCCCCACGAGCCATGGCTGT
GCTGGAGTCACTACGGGTCATCATCACCAACTTTCCTGCTGCCAAGTCCTTGGACATCCAGGTGCCCAAC
TTCCCAGCTGATGAGACCAAAGGCTTCCATCAGGTTCCCTTTGCACCCATTGTCTTCATTGAGAGGACTG
ACTTCAAGGAGGAGCCAGAGCCAGGATTTAAGCGCCTGGCTTGGGGCCAGCCTGTGGGCCTGAGGCATAC
AGGCTACGTCATTGAGCTGCAGCATGTTGTCAAGGGCCCCAGTGGTTGTGTAGAGAGTCTGGAGGTGACC
TGCAGACGGGCAGATGCTGGAGAGAAGCCAAAGGCCTTTATTCACTGGGTGTCACAGCCTTTGATGTGTG
AGGTTCGCCTCTATGAGCGACTATTCCAGCACAAGAACCCTGAAGATCCTACTGAGGTGCCTGGTGGATT
TTTAAGTGACCTGAACCTGGCATCACTACACGTGGTGGATGCAGCATTAGTGGACTGCTCTGTGGCCCTG
GCAAAACCCTTCGACAAGTTCCAGTTTGAGCGTCTTGGATATTTCTCCGTGGATCCAGACAGCCATCAGG
GAAAGCTTGTCTTTAACCGAACTGTCACACTGAAGGAAGACCCAGGAAAGGTGTGAGCTGGAAGCACTGA
ACCTACCTCATCCTCCTGGAGGGTGTGGCTACCCTCGCCACCCCAAATTCCATGTCAATAAAGAACAGCT
AAATTCTCCTAAAAAAAAAAAAAAAA

Figure 20 (Continued)

```
>gi|34193742|gb|BC018137.2| Homo sapiens TATA box binding protein (TBP)-
associated factor, RNA polymerase I, B, 63kDa, mRNA (cDNA clone MGC:9349
IMAGE:3846611), complete cds
CTCGCGTTTCCGGCCGGAAGGCTTCTCCAGCCTTTCCGGAAGCTGCGCTCGCTACCCGGGTAACGGGTC
CCGGCTGTGGAAGCTCCCGCGGCGCCGCGATGGACCTCGAGGAGTCGGAAGAGTTTAAAGAACGCTGTAC
TCAGTGTGCTGCTGTCTCATGGGGTCTTACTGATGAAGGCAAATATTATTGCACTTCTTGCCACAATGTT
ACAGAGAGATATCAGGAAGTTACAAACACTGATCTTATTCCTAATACCCAAATAAAAGCCCTCAACCGGG
GGCTTAAAAAAAAAAACAATACTGAAAAAGGCTGGGATTGGTATGTGTGTGAAGGTTTCCAGTATATTCT
TTATCAACAAGCAGAAGCCTTAAAGAACCTTGGAGTAGGCCCAGAGTTAAAGAACGATGTTTTACATAAT
TTTTGGAAGCGCTACCTTCAGAAGAGCAAGCAGGCATATTGTAAGAACCCAGTTTATACCACTGGAAGGA
AACCTACGGTATTAGAAGATAATCTAAGTCATTCAGACTGGGCTAGTGAGCCTGAGCTGCTAAGTGATGT
CAGCTGTCCTCCTTTTCTTGAAAGTGGAGCGGAGTCTCAGTCTGACATCCACACTCGAAAACCTTTCCCC
GTCAGCAAAGCATCACAATCAGAAACGTCTGTCTGCTCTGGATCTCTGGATGGAGTTGAATACTCACAAC
GAAAGGAGAAGGGAATCGTGAAGATGACCATGCCACAGACACTTGCCTTCTGTTATCTGTCCTTACTTTG
GCAGAGAGAAGCAATAACACTTTCAGATCTTTTGAGGTTTGTTGAAGAGGACCATATTCCTTACATAAAT
GCTTTTCAGCATTTTCCAGAACAGATGAAATTATATGGACGTGACAGAGGAATCTTTGGTATAGAGTCTT
GGCCTGACTACGAGGACATCTATAAAAAAACAATAGAAGTTGGAACATTTTTAGATTTGCCTCGTTTTCC
AGACATAACTGAAGACTGCTATCTTCATCCCAACATACTGTGTATGAAATACTTGATGGAAGTCAACCTC
CCTGATGAAATGCATAGCTTAACTTGCCACGTGGTAAAAATGACTGGAATGGGAGAAGTGGATTTTCTGA
CATTTGATCCTATAGCCAAAATGGCAAAAGCTGTTAAGTACGATGTACAAGCTGTAGCTATCATTGTGGT
GGTATTGAAACTGCTCTTTCTATTGGATGACAGTTTCGAGTGGTCTTTGTCTAATCTTGCTGAAAAGCAT
AATGAAAAGAACAAAAAAGATAAGCCATGGTTTGATTTCAGAAAGTGGTACCAAATTATGAAGAAAGCTT
TTGATGAGAAAAAACAAAAATGGGAAGAAGCAAGGGCCAAGTACCTGTGGAAAAGTGAAAAGCCACTCTA
CTACTCATTTGTCGACAAACCAGTAGCATATAAAAAAAGAGAAATGGTGGTGAATCTACAGAAACAATTT
AGCACACTGGTCGATTCAACAGCAACTGCTGGAAAAAAAAGCCCTTCAAGTTTTCAGTTCAACTGGACTG
AAGAGGACACTGATAGAACGTGTTTCCATGGACACAGCCTTCAGGGAGTCCTGAAAGAGAAAGGCCAATC
ACTGCTGACTAAGAATTCATTATATTGGCTTAGTACACAGAAATTCTGCAGATGCTATTGTACACATGTG
ACAACCTATGAAGAATCAAATTATTCTCTGAGTTATCAGTTTATACTAAATCTCTTCTCCTTCCTGCTCA
GAATAAAGACTTCCCTTCTCCATGAAGAAGTGAGCTTAGTTGAAGAAACTTTTTGAGAAAAAATACAG
TGTAAAAGAAAGAAATCAAGATCCAAGAAAGTGAGACGACATTGAGAAAATGAAATAGAAACTTTCTGG
AAAAATATTTTAATAGTGATAATAACATCAGATTTTAATATAACATTCCAGAGAATTGTGGAAAATACTG
CATATATATGTATAGACTCTGACACATATTTACATATATATCAAGTGTGCTTAGAAAAATGTATATTGTA
AAGCAGGTGAGCTTCATTTGATTTTATTTTTCAGAGTATGAACATTCTAAGAGAAAGTTAAAACAATAGC
AAATTGTATAATTGTATCCAGAAATGTATACTCATCATATTTTAAAGCTAAATTTATTTTTTAAACTAGA
TCCCTTCATTATTCTTTATGCCCCAGAGTAAATCCCAGATGGATCAAAGATCTAAACATAATCTTTCATA
TGTAAAAATATAAAAGTATTAGTAGAAAACAAATATGAATGCTTTGATGAAAAAAAAAAAAAAAAAA >gi|17511731|gb|BC018722.1| Homo sapiens alveolar soft part sarcoma chromosome
region, candidate 1, mRNA (cDNA clone MGC:31811 IMAGE:4640076), complete cds
AAATGGCGGCCCCGGCAGGCGGCGGAGGCTCCGCGGTGTCGGTGCTGGCCCCGAACGGCCGGCGCCACAC
GGTGAAGGTGACGCCGAGCACCGTGCTGCTTCAGGTTCTGGAGGACACGTGCCGGCGGCAGGACTTCAAC
```

Figure 20 (Continued)

```
CCCTGTGAATATGATCTGAAGTTTCAGAGGAGCGTGCTCGACCTTTCTCTCCAGTGGAGATTTGCCAACC
TGCCCAACAATGCCAAGCTGGAGATGGTGCCCGCTTCCCGGAGCCGTGAGGGGCCTGAGAACATGGTTCG
CATCGCTTTGCAGCTGGACGATGGCTCGAGGTTGCAGGACTCTTTCTGTTCAGGCCAGACCCTCTGGGAG
CTTCTCAGCCATTTTCCACAGATCAGGGAGTGCCTGCAGCACCCCGGCGGGGCCACCCCAGTCTGCGTGT
ACACGAGGGATGAGGTGACGGGTGAAGCTGCCCTGCGGGGCACGACGCTGCAGTCGCTGGGCCTGACCGG
GGGCAGCGCCACCATCAGGTTTGTCATGAAGTGCTACGACCCCGTGGGCAAGACCCCAGGAAGCCTGGGC
TCGTCAGCGTCGGCTGGCCAGGCAGCCGCCAGCGCTCCACTTCCCTTGGAATCTGGGGAGCTCAGCCGCG
GCGACTTGAGCCGTCCGGAGGACGCGGACACCTCAGGGCCCTGCTGCGAGCACACTCAGGAGAAGCAGAG
CACAAGGGCACCCGCAGCTGCCCCCTTTGTTCCTTTCTCGGGTGGGGACAGAGACAGGGGGGCCCTCCT
GGGCCCACGAGGCCTCTGACATCATCTTCAGCTAAGTTGCCGAAGTCCCTCTCCAGCCCTGGAGGCCCCT
CCAAGCCAAAGAAGTCCAAGTCGGGCCAGGATCCCCAGCAGGAGCAGGAGCAGGAGCGGGAGCGGGATCC
CCAGCAGGAGCAGGAGCGGGAGCGGCCCGTGGACCGGGAGCCCGTGGACCGGGAGCCGGTGGTGTGCCAC
CCCGACCTGGAGGAGCGGCTGCAGGCCTGGCCAGCGGAGCTGCCTGATGAGTTCTTTGAGCTGACGGTGG
ACGACGTGAGAAGACGCTTGGCCCAGCTCAAGAGTGAGCGGAAGCGCCTGGAAGAAGCCCCCTTGGTGAC
CAAGGCCTTCAGGGAGGCGCAGATAAAGGAGAAGCTGGAGCGCTACCCAAAGGTGGCTCTGAGGGTCCTG
TTCCCCGACCGCTACGTCCTACAGGGCTTCTTCCGCCCCAGCGAGACAGTGGGGGACTTGCGAGACTTCG
TGAGGAGCCACCTGGGGAACCCCGAGCTGTCATTTTACCTGTTCATCACCCCTCCAAAAACAGTCCTGGA
CGACCACACGCAGACCCTCTTTCAGGCGAACCTCTTCCCGGCCGCTCTGGTGCACTTGGGAGCCGAGGAG
CCGGCAGGTGTCTACCTGGAGCCTGGCCTGCTGGAGCATGCCATCTCCCCATCTGCGGCCGACGTGCTGG
TGGCCAGGTACATGTCCAGGGCCGCCGGGTCCCCTTCCCCATTGCCAGCCCCTGACCCTGCACCTAAGTC
TGAGCCAGCTGCTGAGGAGGGGCGCTGGTCCCCCCTGAGCCCATCCCAGGGACGGCCCAGCCCGTGAAG
AGGAGCCTGGGCAAGGTGCCCAAGTGGCTGAAGCTGCCGGCCAGCAAGAGGTGAGAGCTGCCAGCCTGAG
GTGCCCACTCCGCCAGCCACAGGACCACCTCCTCTGCCAGCAGGAATAAAGACTTGTGCATCCCTCAAAA
AAAAAAAAAAAAAAAAAAAAAAAAAAAAAAAAAAAAAAAAAAAA

>gi|18044224|gb|BC020221.1| Homo sapiens SH3 and cysteine rich domain, mRNA (cDNA
clone MGC:31915 IMAGE:4589443), complete cds
GAGGCTGGAGGAGGGCACGTCGGCGCCTCGGCGAGGATGGGAGTCCCCAGGACCCGGAGCTGAGCAGCCT
GGCGCGCGGCGGGCAGGGCGCGCAGGACAGAAGCCTCGCTGTTCCTCCGGGAGCCCAACACCGTTCCCGC
GCGGCCACGATGATCCCTCCGAGCAGCCCCGCGAGGACGGCGTGGACGGGCTGCCCAAGGAGGCGGTGG
GCGCCGAGCAACCGCCCTCTCCTGCATCCACCAGCAGCCAGGAATCCAAGCTCCAGAAACTAAAACGATC
ACTTTCTTTCAAGACCAAGAGTTTACGGAGCAAAAGTGCTGACAACTTCTTCCAGCGAACCAACAGCGAA
GACATGAAACTGCAAGCACACATGGTGGCTGAGATCAGCCCCAGCTCCAGCCCACTCCCTGCTCCAGGAA
GCCTGACGTCCACACCCGCCAGGGCTGGTCTGCATCCAGGTGGCAAGGCTCATGCCTTTCATGAATACAT
CTTCAAGAAGCCCACTTTCTGTGATGTCTGCAACCACATGATAGTGGGAACAAATGCTAAGCATGGACTG
CGCTGCAAAGCCTGTAAGATGAGCATCCACCACAAGTGCACAGATGGCCTGGCACCCCAGCGGTGCATGG
GCAAGCTGCCAAAGGGGTTTCGGCGTTACTACAGCTCCCCCTTGCTCATTCATGAACAGTTTGGCTGCAT
TAAAGAAGTTATGCCCATTGCCTGTGGCAATAAGGTGGACCCTGTCTACGAGACCCTCCGCTTCGGCACC
TCCCTGGCCCAGAGGACAAAGAAGGGCAGCTCCGGCAGTGGCTCTGACTCACCTCACAGAACCTCTACTT
CAGATCTTGTGGAGGTTCCTGAGGAAGCCAATGGGCCAGGAGGCGGGTATGACCTAAGGAAACGCAGCAA
CAGCGTGTTTACATATCCAGAAAATGGCACTGATGATTTCAGAGATCCAGCGAAGAACATAAACCACCAG
GGATCTCTTTCCAAAGACCCATTACAGATGAACACCTATGTTGCCTTGTACAAATTTGTACCACAGGAGA
```

Figure 20 (Continued)

```
ATGAAGATTTGGAAATGAGGCCAGGAGACATAATTACTCTTTTAGAGGATTCCAATGAAGACTGGTGGAA
AGGGAAAATTCAAGACAGAATTGGCTTCTTTCCAGCCAACTTTGTTCAGAGACTACAACAAAATGAGAAG
ATTTTTAGATGTGTTAGAACCTTCATTGGGTGTAAGGAACAGGGGCAGATAACACTGAAAGAGAATCAGA
TCTGCGTGAGTTCTGAAGAAGAACAAGATGGTTTTATCAGAGTCCTCAGTGGAAAAAAGAAAGGCCTCAT
CCCCCTTGATGTACTAGAAAACATCTGATTGCTGGCTCCTCCTCCGTTTGCAGTAGGCAAGCTCTGCTGC
GATGCCTCTGCCTCATCTCACACTGCGTCAACCCAAAGGAGCTGCCGCACTGACCCAGCCCCCCAGGAAA
CAGTGAGACAAGAATCAAGTATCTGAGACTGTGGAGTAATAGCCACAAAACAGAGGGCCCACTGCACAGC
ATATCCAGGCTGCCACAGGTGGGACGAGGCTGAGAGAGTCAGCAGGCAGAGCCAGATGCCATGCTTGGC
AGCAGCAGTAGGACTATAAACCACAGCTGTCCCCAGGATCCCACTCCTTTCCTGTCTGTGTGGTGTAAG
TTAACACACTGGAGTGTGCTCCAGTTTGCAGGGTAGCCCAGTGCAAGGTTCAGATCCATGTAGCTAAGTA
TTATCCTGCTTCCAGACCTATGTCACCAGTACCAATCAGTCAGTGTCATCACATTTCAGGCCCCAAGCAA
TCTCTGTGCAAAGCATCAGAAAGACCTGCTTCCCAGCCCCCAGCATTCCAGTGCTCTCCAGGCTTCCTCT
CTTTGTGATTGTGCTGTCCAGAGTGTCCAGCTTGTTCTTTCTTTCTCTTCAGTCCTCTGAGTACATCTGG
TGGTGTGCATTAGATGTGAGGGCTATGTTGACATGGCATCACCTCCAAAGACCTGACCTGCCTAAAGACT
GATGACAGGCCATCCTTCCTGCTGTTCTAGGTACTGGCCTGGGTGACAGAGCAGGACATGAGACATAGAT
ACAGTGGGGAGGAGAAGTGGGGAAAGGTGGAGCAGAGAGTTCTTACTTATTGAAGATTATACAGCCCTTT
CGGTTATGAAGTCCCTGCTTGAAGGCAATGGACCTGGGGAAGAGACTATCACAAAAAGTCTCCATTTTCA
TTTTACATCCTCTCTATTGGAGGCAGCACTTTTCCCTCATGCTGTCCTATAGGACTCCACTTTGAAGGTT
GTGCCTACGTTGCAGGGAACTAGGAACATGGAGGGGAACCAACAACAGCATCTTAGAAGAAATGTAGCCA
AATTGGAGTCCATTCTTCTTTAGGGCAGTATATGAAATCCTAGCAGATGTAAAATGGAAAAGAATCCTAA
TGCTTCTTCCTTCAGAAAGTAGAGGAACTAGGGGCCCAATTAGCATCATCTAGGGGAATCTCTATTACTC
TGTACTTATACTAATGTTTACAAGAATGCAATATACTGTGATGCCTTCCTACTCAAGCCTCCTAGCATTC
AAACTTCCATCCTATTAGTCATTAACATGGTTAAACTTCAATTCACAATCACCTTGGAATCAATGTCAGT
TTGATTTATTTTGTTACAGAGCAATAAAATCATTAGAACAATGAAAAAAAAAAAAAAAAAAA
```

>gi|18490812|gb|BC022244.1| Homo sapiens pyrroline-5-carboxylate reductase 1,
mRNA (cDNA clone MGC:22061 IMAGE:4420238), complete cds

```
GCCCTGGCCAAGGGCTTCACAGCAGCAGGCGTCTTGGCTGCCCACAAGATAATGGCTAGCTCCCCAGACA
TGGACCTGGCCACAGTTTCTGCTCTCAGGAAGATGGGGGTGAAGTTGACACCCCACAACAAGGAGACGGT
GCAGCACAGTGATGTGCTCTTCCTGGCTGTGAAGCCACACATCATCCCCTTCATCCTGGATGAAATAGGC
GCCGACATTGAGGACAGACACATTGTGGTGTCCTGCGCGGCCGGCGTCACCATCAGCTCCATTGAGAAGA
AGCTGTCAGCGTTTCGGCCAGCCCCCAGGGTCATCCGCTGCATGACCAACACTCCAGTCGTGGTGCGGGA
GGGGGCCACCGTGTATGCCACAGGCACGCACGCCCAGGTGGAGGACGGGAGGCTCATGGAGCAGCTGCTG
AGCAGCGTGGGCTTCTGCACGGAGGTGGAAGAGGACCTGATTGATGCCGTCACGGGGCTCAGTGGCAGCG
GCCCCGCCTACGCATTCACAGCCCTGGATGCCCTGGCTGATGGGGTGTGAAGATGGGACTTCCAAGGCG
CCTGGCAGTCCGCCTCGGGCCCAGGCCCTCCTGGGGGCTGCCAAGATGCTGCTGCACTCAGAACAGCAC
CCAGGCCAGCTCAAGGACAACGTCAGCTCTCCTGGTGGGGCCACCATCCATGCCTTGCATGTGCTGGAGA
GTGGGGGCTTCCGCTCCCTGCTCATCAACGCTGTGGAGGCCTCCTGCATCCGCACGGGAGCTGCAGTC
CATGGCTGACCAGGAGCAGGTGTCACCAGCCGCCATCAAGAAGACCATCCTGGACAAGGTGAAGCTGGAC
TCCCCTGCAGGGACCGCTCTGTCGCCTTCTGGCCACACCAAGCTGCTCCCCCGCAGCCTGGCCCCAGCGG
GCAAGGATTGACACGTCCTGCCTGACCACCATCCTGCCACCACCTTCTCTTCTCTTGTCACTAGGGGAC
TAGGGGGTCCCCAAAGTGGCCCACTTTCTGTGGCTCTGATCAGCGCAGGGGCCAGCCAGGGACATAGCCA
```

Figure 20 (Continued)

```
GGGAGGGGCCACATCACTTCCCACTGGAAATCTCTGTGGTCTGCAAGTGCTTCCCAGCCCAGAACAGGGG
TGGATTCCCCAACCTCAACCTCCTTTCTTCTCTGCTCCCAAACCATGTCAGGACCACCTTCCTCTAGAGC
TCGGGAGCCCGGAGGGTCTTCACCCACTCCTACTCCAGTATCAGCTGGCACGGGCTCCTTCCTGAGAGCA
AAGGTCAAGGACCCCCTCTGTGAAGGCTCAGCAGAGGTGGGATCCCACGCCCCTCCCGGCCCCTCCCTG
CCCTCCATTCAGGGAGAAACCTCTCCTTCCCGTGTGAGAAGGGCCAGAGGGTCCAGGCATCCCAAGTCCA
GCGTGAAGGGCCACAGCCCCTCTTGGCTGCCAAGCACGCAGATCCCATGGACATTTGGGGAAAGGGCTCC
TTGGGCTGCTGGTGAACTTCTGTGGCCACCACCTCCTGCTCCTGACCTCCCTGGGAGGGTGCTATCAGTT
CTGTCCTGGCCCTTTCAGTTTTATAAGTTGGTTTCCAGCCCCCAGTGTCCTGACTTCTGTCTGCCACATG
AGGAGGGAGGCCCTGCCTGTGTGGGAGGGTGGTTACTGTGGGTGGAATAGTGGAGGCCTTCAACTGATTA
GACAAGGCCCGCCCACATCTTGGAGGGCATCTGCCTTACTGATTAAAATGTCAATGTAATCTAAAAAAAA
AAAAAAA

>gi|18490878|gb|BC022436.1| Homo sapiens tumor protein, translationally-
controlled 1, mRNA (cDNA clone MGC:24736 IMAGE:4281364), complete cds
ATATGAGGTTGGGGAGCGGCTGAGTCGGCCTTTTCCGCCCGCTCCCCCCTCCCCCCGAGCGCCGCTCCGG
CTGCACCGCGCTCGCTCCGAGTTTCAGGCTCGTGCTAAGCTAGCGCCGTCGTCGTCTCCCTTCAGTCGCC
ATCATGATTATCTACCGGGACCTCATCAGCCATGGTCAGTAGGACAGAAGGTAACATTGATGACTCGCTC
ATTGGTGGAAATGCCTCCGCTGAAGGCCCCGAGGGCGAAGGTACCGAAAGCACAGTAATCACTGGTGTCG
ATATTGTCATGAACCATCACCTGCAGGAAACAAGTTTCACAAAAGAAGCCTACAAGAAGTACATCAAAGA
TTACATGAAATCAATCAAAGGAAACTTGAAGAACAGAGACCAGAAAGAGTAAAACCTTTTATGACAGGG
GCTGCAGAACAAATCAAGCACATCCTTGCTAATTTCAAAAACTACCAGTTCTTTATTGGTGAAAACATGA
ATCCAGATGGCATGGTTGCTCTATTGGACTACCGTGAGGATGGTGTGACCCCATATATGATTTTCTTTAA
GGATGGTTTAGAAATGGAAAAATGTTAACAAATGTGGCAATTATTTTGGATCTATCACCTGTCATCATAA
CTGGCTTCTGCTTGTCATCCACACAACACCAGGACTTAAGACAAATGGGACTGATGTCATCTTGAGCTCT
TCATTTATTTTGACTGTGATTTATTTGGAGTGGAGGCATTGTTTTTAAGAAAAACATGTCATGTAGGTTG
TCTAAAAATAAAATGCATTTAAACTCATTTGAGAGAATGCCTTTTAGTTTAATGCATATTTAAACTAAAT
TGATCCTGTAGTGTTCCTGGAGAAGCTAGAGCCTGATTGTAGGCTACTACTCATCAATTAACTTCTACAG
TGGAGACTACTTCTGGGACTGGAATATAAAAAAGAATCAAAGGTTCTGATTTTGAGTTGCAATAAAGGGA
AAGACCATGCTCATAGCAGTGCCAACATCTGAAGTGTGGAGCCTTACCCATTTCATCACCTACAACGGAA
GTAGTTAACTGGAAGAGATTACCAAGAGAATAAAAAGAGACTCATTCAGTGCCAAAAAAAAAAAAAAAAA
AAAAAAAAAAAAAA >gi|18605596|gb|BC022888.1| Homo sapiens xin actin-binding repeat containing 2,
mRNA (cDNA clone IMAGE:4338489)
GGGATAGAAGAGTTTATGCAAAGGGAGAAACAAACCATAACATACAACAAGAAAGTCGTACATTTTGTAA
GGAGGAATTTGGATTAACATCTTTAGGAAACACGAGTTTTACAGACTTTTCTTGCAAACATCCTAGAGAA
CTGCGAGAAAAGATTCCTGTTAAGCAGCCCAGGATCTGCTCTGAAACCAGGTCTCTAAGTGAACATTTCT
CAGGCATGGATGCATTTGAGAGTCAAATTGTTGAGTCGAAGATGAAAACCTCTTCATCACATAGCTCAGA
AGCTGGCAAATCTGGCTGTGACTTCAAGCATGCCCCACCAACCTATGAGGATGTCATTGCTGGACATATT
TTAGATATCTCTGATTCACCTAAAGAAGTAAGAAAAAATTTTCAAAAGACGTGGCAAGAGAGTGGAAGAG
TTTTTAAAGGCCTGGGATATGCAACCGCAGATGCTTCTGCAACTGAGATGAGAACCACCTTCCAAGAGGA
ATCTGCATTTATAAGTGAAGCTGCTGCTCCAAGACAAGGAAATATGTATACTTTGTCAAAAGACAGTTTA
```

Figure 20 (Continued)

```
TCCAATGGAGTGCCTAGTGGCAGACAAGCAGAATTTTCATAAGTCCTGCTTCCGATGCCACCATTGCAAC
AGTAAACTAAGTTTGGGAAATTATGCATCACTTCATGGACAAATATACTGTAAACCTCACTTTAAACAAC
TTTTCAAATCCAAAGGAAATTATGATGAAGGTTTTGGACATAAGCAGCATAAAGATAGATGGAACTGCAA
AAACCAAAGCAGATCAGTGGACTTTATTCCTAATGAAGAACCAAATATGTGTAAAAATATTGCAGAAAAC
ACCCTTGTACCTGGAGATCGTAATGAACATTTAGATGCTGGTAACAGTGAAGGGCAAAGGAATGATTTGA
GAAAATTAGGGGAAAGGGGAAAATTAAAAGTCATTTGGCCTCCTTCCAAGGAGATCCCTAAGAAAACCTT
ACCCTTTGAGGAAGAGCTCAAAATGAGTAAACCTAAGTGGCCACCTGAAATGACAACCCTGCTATCCCCT
GAATTTAAAAGTGAATCTCTGCTAGAAGATGTTAGAACTCCAGAAAATAAAGGACAAAGACAAGATCACT
TTCCATTTTTGCAGCCTTATCTACAGTCCACCCATGTTTGTCAGAAAGAGGATGTTATAGGAATCAAAAA
AAAAAAAAAAAAAAAAAAAAAAAAAA

>gi|18605734|gb|BC022983.1| Homo sapiens ligand of numb-protein X 1, mRNA (cDNA
clone MGC:29996 IMAGE:4995278), complete cds
GCTCGGTTCACCCACAAGGAATGAGAGCTGCCTGCCTGCTGCTGCTTGGAGAGCCCCAGACAGTCGCTTG
AAGAGGTGTGTGGATGTCTCCTAGATCTTGACTTGCTCCTGAGGAAATATTGTGTGACTGAGTTTCCTGT
TATACTGCTCTCCAATCCATCATGAACCAGCCAGAGTCTGCCAACGATCCTGAACCCCTGTGTGCAGTGT
GTGGCCAAGCCCACTCCTTGGAGGAAAACCACTTCTACAGCTATCCAGAGGAAGTGGATGATGACCTCAT
CTGCCACATCTGCCTGCAGGCTTTGCTGGACCCCCTGGACACTCCGTGTGGACACACCTACTGCACCCTC
TGCCTCACCAACTTCCTGGTGGAGAAGGACTTCTGTCCCATGGACCGCAAGCCTCTGGTTCTGCAGCACT
GCAAGAAGTCCAGCATCCTGGTCAACAAACTCCTCAACAAGCTACTGGTGACCTGCCCATTCAGGGAGCA
CTGCACCCAGGTGTTGCAGCGCTGTGACCTCGAGCATCACTTTCAAACCAGCTGTAAAGGTGCCTCCCAC
TACGGCCTGACCAAAGATAGGAAGAGGCGCTCACAAGATGGCTGTCCAGACGGCTGTGCGAGCCTCACAG
CCACGGCTCCCTCCCAGAGGTTTCTGCAGCTGCCACCATCTCCTTAATGACAGACGAGCCTGGCCTAGA
CAACCCTGCCTACGTGTCCTCGGCAGAGGACGGGCAGCCAGCAATCAGCCCAGTGGACTCTGGCCGGAGC
AACCGAACTAGGGCACGGCCCTTTGAGAGATCCACTATTAGAAGCAGATCATTTAAAAAAATAAATCGAG
CTTTGAGTGTTCTTCGAAGGACAAAGAGCGGGAGTGCAGTTGCCAACCATGCCGACCAGGGCAGGGAAAA
TTCTGAAAACACCACTGCCCCTGAAGTCTTTCCAAGGTTGTACCACCTGATTCCAGATGGTGAAATTACC
AGCATCAAGATCAATCGAGTAGATCCCAGTGAAAGCCTCTCTATTAGGCTGGTGGGAGGTAGCGAAACCC
CACTGGTCCATATCATTATCCAACACATTTATCGTGATGGGGTGATCGCCAGAGACGGCCGGCTACTGCC
AGGAGACATCATTCTAAAGGTCAACGGGATGGACATCAGCAATGTCCCTCACAACTACGCTGTGCGTCTC
CTGCGGCAGCCCTGCCAGGTGCTGTGGCTGACTGTGATGCGTGAACAGAAGTTCCGCAGCAGGAACAATG
GACAGGCCCCGGATGCCTACAGACCCCGAGATGACAGCTTTCATGTGATTCTCAACAAAAGTAGCCCCGA
GGAGCAGCTTGGAATAAAACTGGTGCGCAAGGTGGATGAGCCTGGGGTTTTCATCTTCAATGTGCTGGAT
GGCGGTGTGGCATATCGACATGGTCAGCTTGAGGAGAATGACCGTGTGTTAGCCATCAATGGACATGATC
TTCGATATGGCAGCCCAGAAAGTGCGGCTCATCTGATTCAGGCCAGTGAAAGACGTGTTCACCTCGTCGT
GTCCCGCCAGGTTCGGCAGCGGAGCCCTGACATCTTTCAGGAAGCCGGCTGGAACAGCAATGGCAGCTGG
TCCCCAGGGCCAGGGGAGAGGAGCAACACTCCCAAGCCCCTCCATCCTACAATTACTTGTCATGAGAAGG
TGGTAAATATCCAAAAAGACCCCGGTGAATCTCTCGGCATGACCGTCGCAGGGGGAGCATCACATAGAGA
ATGGGATTTGCCTATCTATGTCATCAGTGTTGAGCCCGGAGGAGTCATAAGCAGAGATGGAAGAATAAAA
ACAGGTGACATTTTGTTGAATGTGGATGGGGTCGAACTGACAGAGGTCAGCCGGAGTGAGGCAGTGGCAT
TATTGAAAAGAACATCATCCTCGATAGTACTCAAAGCTTTGGAAGTCAAAGAGTATGAGCCCCAGGAAGA
CTGCAGCAGCCCAGCAGCCCTGGACTCCAACCACAACATGGCCCCACCCAGTGACTGGTCCCCATCCTGG
```

Figure 20 (Continued)

GTCATGTGGCTGGAATTACCACGGTGCTTGTATAACTGTAAAGATATTGTATTACGAAGAAACACAGCTG
GAAGTCTGGGCTTCTGCATTGTAGGAGGTTATGAAGAATACAATGGAAACAAACCTTTTTTCATCAAATC
CATTGTTGAAGGAACACCAGCATACAATGATGGAAGAATTAGATGTGGTGATATTCTTCTTGCTGTCAAT
GGTAGAAGTACATCAGGAATGATACATGCTTGCTTGGCAAGACTGCTGAAAGAACTTAAAGGAAGAATTA
CTCTAACTATTGTTTCTTGGCCTGGCACTTTTTTATAGAATCAATGATGGGTCAGAGGAAAACAGAAAAA
TCACAAATAGGCTAAGAAGTTGAAACACTATATTTATCTTGTCAGTTTTTATATTTAAAGAAAGAATACA
TTGTAAAAATGTCAGGAAAAGTATGATCATCTAATGAAAGCCAGTTACACCTCAGAAAATATGATTCCAA
AAAAATTAAAACTACTAGTTTTTTTTTCAGTGTGGAGGATTTCTCATTACTCTACAACATTGTTTATATTT
TTTCTATTCAATAAAAAGCCCTAAAACAACTAAAATGATTTGTATACCCCACTGAATTCAAGCTGATTTA
AATTTAAAATTTGGTATATGCTGAAGTCTGCCAAGGGTACATTATGGCCATTTTTAATTTACAGCTAAAA
TATTTTTTAAAATGCATTGCTGAGAAACGTTGCTTTCATCAAACAAGAATAAATATTTTTCAGAAAAAAA
AAAAAAAA

>gi|18605502|gb|BC023152.1| Homo sapiens glycogenin 2, mRNA (cDNA clone MGC:9153
IMAGE:3923041), complete cds
GGCAGCCAGAGCGCGGAAGAGGCCTGGAAATCCACGCGGATTCCCGGAGACGGCGCCTCTGCTCTGCGGG
TTCGTGGCGAGGAAGTCCACCCACTGCTCCCGGGCGCAGGTCTGCAGGTCCGCGCCCACTGCCCGCGGCG
CCACTGACCATGTCGGTGACTGATCAGGCTTTTGTCACACTAGCCACCAATGACATCTACTGCCAGGGCG
CCCTGGTCCTGGGGCAGTCACTGAGGAGACACAGGCTGACGAGGAAGCTGGTGGTGTTGATCACTCCTCA
GGTGTCCAGCCTGCTCAGGGTCATCCTCTCGAAGGTGTTCGATGAAGTCATTGAAGTGAATCTAATCGAT
AGTGCCGACTACATCCACCTGGCCTTTCTGAAGAGACCTGAGCTCGGGCTCACCCTCACCAAGCTTCACT
GTTGGACTCTCACTCACTACAGCAAGTGTGTCTTCCTGGATGCAGACACTCTGGTGCTGTCCAATGTCGA
TGAGCTGTTTGACAGGGGAGAGTTTTCTGCGGCCCCGGACCCCGGATGGCCGGATTGCTTCAATAGCGGG
GTGTTTGTCTTCCAGCCTTCTCTCCACACGCATAAACTCCTGCTACAGCACGCCATGGAACACGGCAGCT
TTGACGGGGCAGACCAAGGCTTACTGAATAGTTTCTTCAGGAACTGGTCGACCACAGACATCCACAAGCA
CCTGCCGTTCATCTATAACTTGAGTAGTAACACGATGTACACTTACAGCCCTGCCTTCAAGCAATTCGGT
TCCAGTGCAAAGGTCGTCCACTTTTTGGGGTCCATGAAACCTTGGAACTACAAGTACAATCCACAGAGTG
GCTCGGTGTTGGAGCAAGGCTCAGTGTCCAGCAGCCAGCACCAGGCGGCATTCCTTCATCTCTGGTGGAC
GGTCTACCAGAACAACGTGCTGCCCCTTTATAAAAGCGTCCAAGCGGGGAAGCACGCGCGTCTCCTGGT
CACACACTTTGCCGCAGTGATGTGGGGGGGCCGTGTGCGGATTCAGCCTCTGGTGTTGGAGAGCCGTGTG
AAAATTCAACACCCAGTGCGGGCGTGCCGTGTGCAAATTCACCACTGGGTTCTAACCAGCCTGCTCAGGG
CCTTCCGGAGCCGACCCAGATAGTGGATGAGACCCTGTCCCTACCTGAAGGACGCCGTTCAGAAGATATG
ATAGCTTGTCCTGAAACTGAGACTCCTGCCGTGATAACGTGTGACCCACTGTCCCAGCCTTCCCCTCAGC
CTGCAGACTTCACAGAGACTGAAACCATCTTGCAGCCAGCAAATAAAGTCGAAAGTGTCTCATCCGAGGA
AACCTTCGAACCAAGCCAGGAACTCCCTGCTGAGGCTCTCAGGGACCCCAGTCTGCAGGATGCACTGGAG
GTCGACCTGGCCGTCTCTGTTTCCCAGATCTCCATCGAAGAGAAGGTGAAGGAATTGAGCCCCGAGGAAG
AGAGGAGGAAGTGGGAGGAAGGCCGTATCGACTACATGGGGAAGGACGCGTTTGCTCGCATCCAGGAGAA
GCTGGACCGGTTCCTGCAGTAATCCGGCAGCTGGTGGGCGTTGTGTAGTTAGACAATGTCCTGTTGGG
TGGTCCTGTTGCGTGGAGATCTCCTCTGGTCCTTTCAAAGGGAAACGCTGTTGAACCTTGTGCCTCTATT
TATGCTTAATCCATTTGAGTGCCTCACACAAAAAACGTAGAGTATAGAAATCCACCTTAAAGCCCCTCGC
CCCAACTTCTCCACCAACGCCTTCTGGGCTTTCTTCAGAGGTCACTTCTACCCTTGAAGCTGTCGGCAAA
AGCGAGCAGTAATAACATTCTAGTAGACTCTCGATGGTGGTCTCCGCTCTTGCCCGAAGGACCTCTGAAG Figure 20 (Continued)

```
TACGCTGGAGCTGTGTTGTACAGGTGCTGTGAGACCTACCCTATTCAGAATTAAACCTCACTGCAAATTT
CCTCCCATCACGAAGCTAACAACACTAATATACGTATTTAGCACCTCTGAGGCTTTGCCATGGAGACCCA
TTTCTGTAGGGCTAAGGAAACATTTAGACGTGGTGACTGACTTTCATTTGGACTTGGCGAAGTGTATCTG
AGAAACACCTCGGCTGTGGTCTCTCTGCTTTAAATCCTAACAGGACTTCCTAGAGCGTTGACAGAAATTC
TACTCGTGGACGTTGGGAAGAAAGATTGTAGGTGGCTTGGGGAATGTGGGTGGCTTAGAGGATCTAAACC
GATTCACTTCCTGGTTGAGAAGCAACGAGGGCTTGCTCTAAATCGTTTAGAGGATAACAGGATCTAGAGA
TGCTCTCTGCTTGACAACAAAAGTCAGGGTGCAGTCGGTCCACCCTTGACTGCTCTTGGCTTGGTCTCTA
CCCTCACTACCTCAGTTCTCAATAACTTAGTGAATCACTGCCCTCCTCAAAGCCATTTCCACTCAGCTCT
TTCCAGAGAATTCTCAGTTTTATGAGACGGGAAACTTTATTTCACGAGAAAGCCTCATTGTCAGAAGTAT
CTTCATTCAATGGGCACAATATGCTGTGTATCTCACCAGGTAGCTGTCAGGGGCCACCGAGAGTGTCGTT
AAAAATGGGCATCGTTGTAATAAAGGAGGAAAGTGCGACTTTTGAAATGTTTGGAAGGTTTATTTCTCAT
GCACATTCCAGGGAAAAGCAGAGAGTAAATTAGAGACGGGATAGGAAGGCCGTGGGAGAACTCGATCCTA
GCCTGTGTCAGCTGGATGTGTTTACGTGGAGAGGCGTGGCCACTTTTTAGGTCACCTGAAGCAGTTTAGC
CTTTGGATAGAGGAACCTGCCTGAATTTATGGCATTAGTGGTGGCATTTTTTTGTGTACAAGATGTGGGT
GATGGAGGGGCTGTTTCTTTTTCCGTGTGGGTGGTTAATAATCGTCAGTCTCGGAGGGCGATGCTCGTAG
GATATTTCAGGTGAGTCAGGGTTGGATGGTCATCGGCTTTCAGAGGGAGACCACGGGAATGTTCAGGGAA
ACAATGTCAGCTTCTCTGAGGACCAGAATTCATGTTCACGGGCAGTGATGAGTTGGCTTATGGAGTGAGT
CCAGTCTGGAATTCCGCCGTGCATTCTAGCCTGTATCATCTCATTTGGACAAATGCTGGCACGTTGAAAT
TAAAATGTTAAAAAACAGCAAAAAAAAAAAAAAAA

>gi|19343928|gb|BC025700.1| Homo sapiens AF4/FMR2 family, member 4, mRNA (cDNA
clone IMAGE:5221893), complete cds
CCCGGGCCCGACCGTCATGGAGCGGTGCGGGGCCTACGCCTGTTCCGTGTGAGGCGCATCGCTGCCGCCG
CCGCCGACGCCGCCTTCGTTTGTCGAGGCCTCCGGAACCCCCGCCGCCTCCCGGAGCCCCTCGCCCTTGG
CAGCCTGTCACCGCCCCCTGGGCGGGCTCGAATGCGCGTCCGGTGAAGGTGCAGGCCCGGCGCCGCCACT
GCCGCAGCCAGGAGATGGTTCGGGCCTAGCGGAGCCGGGACTGGAGCAACATGAACCGTGAAGACCGGAA
TGTGCTGCGTATGAAAGAACGGGAAAGGCGGAATCAGGAAATTCAGCAGGGCGAAGACGCCTTCCCACCT
AGCTCTCCTCTCTTTGCAGAGCCATACAAAGTTACTAGCAAAGAAGATAAGTTATCAAGTCGTATTCAGA
GTATGCTTGGAAACTACGATGAAATGAAGGATTTCATAGGAGACAGATCTATACCAAAGCTTGTTGCAAT
TCCCAAGCCTACAGTACCACCATCAGCAGATGAAAAATCTAACCCAAATTTCTTTGAACAGAGACATGGA
GGCTCTCATCAGAGTAGCAAATGGACTCCAGTAGGACCCGCACCCAGCACTTCTCAGTCTCAGAAACGGT
CCTCAGGCTTACAGAGTGGACATAGTAGCCAGCGGACCAGCGCAGGTAGCAGTAGTGGCACTAACAGTAG
TGGTCAGAGGCACGACCGTGAGTCATATAACAATAGTGGGAGCAGTAGCCGGAAAAAAGGCCAGCATGGA
TCAGAACACTCCAAATCACGTTCTTCCAGCCCTGGAAAACCCCAGGCTGTTTCTTCATTAAACTCTAGTC
ATTCCAGGTCTCATGGGAATGATCACCATAGCAAGGAACATCAACGCTCCAAATCACCTCGGGACCCTGA
TGCAAACTGGGATTCTCCTTCCCGTGTACCTTTTTCAAGTGGGCAGCACTCAACTCAATCTTTCCCACCC
TCATTGATGTCAAAGTCCAATTCAATGTTACAGAAACCCACTGCCTATGTGCGGCCCATGGACGGACAGG
AGTCCATGGAACCAAAGCTGTCCTCTGAGCACTACAGCAGCCAATCCCATGGCAACAGCATGACTGAGCT
GAAGCCCAGCAGCAAAGCACATCTCACCAAGCTGAAAATACCTTCCCAACCACTGGATGCATCAGCTTCT
GGTGATGTGAGCTGTGTGGATGAAATCCTAAAAGAGATGACGCATTCATGGCCTCCCCCTCTAACGGCTA
TTCATACACCATGCAAAACAGAACCTTCCAAATTTCCTTTTCCAACTAAGGAGTCTCAGCAGTCCAATTT
TGGCACTGGAGAACAAAGGCTCAAGTGATCCTCCTGCCTCAGCCTACTGAGTAGCTGGGACTGTGGGCAC
```

Figure 20 (Continued)

ATGCCACTATGCCTGGCTGATTTTTTAAATTTTTAGTAGAGATAGGGTCTCACTATGTTGCACAGGCTGG
TCTCGAACTCCTGAGCTCAAGTGATCCACCTGCCTCGCCTCCCAAAGTGTTGGGATTACTGGTGTGAGCC
ACCATGCCCTCGTATCCTAATTTTTATGATCTAATGGGTAGTAGTGGGTTGAGCTGAAAAATTGTTATGC
TTTAAAAAATTCAAGAACTGTAAGTCATTGGAGATCAAAATACACTACTTTTATTAAAAAAAAAAAAAAA
AAAAAAAAAAAAAAAAAAAAAAAAAAAAAAAAAAAAAAAAAAAAAAAAAAAAAAAAAAAAAAAAAAAAAA
AAA

>gi|20070727|gb|BC026213.1| Homo sapiens F-box and WD repeat domain containing
11, mRNA (cDNA clone MGC:21122 IMAGE:4419029), complete cds
GTAGTCGTGGCGCTCTCGAGGCCCTGCCATGAGCAAGCTCTTAACTCTTCAGGTCTGCACGTCCTACGCC
CACCGTCCAGTGCTACTCTCAGCTCGGAGTTCAGCTTCGGGCTGCCAAGAGCCAGCAACCTGGTGTCAGA
GGCTCGGTCCCACAACGCTCTGCGGGCCGCGGCGCCTGCTGGGAGGTGTAGTCCCCGATCTGCGTACTGC
GTTCGCCGAGGGGAGGGCGGAGCTGCCGGCGGCCCGGGCGGGCTGGCAGCTAGAGTGGGTGCGATAGCC
GCCTCCGCCTCTGCCGCCTCCGCCGTCGCCTCCTCCGCCCGGGCCGTTCGCTGCTGCGCGGGGAGAGCGA
GGCGGGGCCGCCGGGGCCGCCATGGAGCCCGACTCGGTGATTGAGGACAAGACCATCGAGCTCATGAACA
CTTCAGTTATGGAAGATCAAAATGAAGATGAGTCCCCAAAGAAAAATACTCTTTGGCAGATAAGTAATGG
AACATCATCTGTGATCGTCTCCAGAAAGAGGCCATCAGAAGGAAACTATCAAAAAGAAAAAGACTTGTGT
ATTAAATATTTTGACCAGTGGTCTGAATCAGATCAAGTGGAATTTGTGGAACATCTTATTTCACGAATGT
GTCATTATCAGCATGGACATATTAACTCTTACCTGAAGCCCATGTTGCAGCGGGACTTTATTACCGCTTT
ACCAGAGCAAGGCTTAGATCACATAGCAGAAAACATTCTTTCGTACCTGGATGCCAGGTCTCTGTGTGCA
GCAGAGCTGGTATGTAAAGAATGGCAGCGAGTGATCTCAGAAGGAATGCTTTGGAAGAAGCTGATTGAAC
GAATGGTACGCACTGATCCCCTATGGAAAGGACTTTCAGAAAGAAGAGGGTGGGATCAGTACCTGTTTAA
AAACAGACCCACAGATGGCCCTCCAAATTCATTTTATAGGTCATTATACCCAAAGATTATCCAGGATATA
GAGACTATAGAATCTAACTGGCGGTGTGGACGACACAACTTGCAGAGGATTCAGTGCCGCTCTGAAAATA
GTAAAGGTGTCTACTGTTTACAGTACGATGATGAAAAAATTATCAGTGGCCTACGAGATAATTCTATTAA
GATATGGGATAAAACCAGCCTGGAATGTTTGAAAGTGTTAACAGGACACACAGGCTCTGTCCTCTGTCTG
CAGTATGATGAGCGTGTCATTGTAACTGGCTCTTCAGATTCTACGGTGAGAGTGTGGGATGTGAACACGG
GTGAAGTTCTTAACACATTGATCCACCACAATGAGGCTGTATTGCACTTACGCTTCAGCAATGGACTGAT
GGTGACCTGTTCCAAGGACCGCTCCATTGCTGTGTGGGACATGGCTTCTGCGACCGACATCACTTTACGC
CGTGTCCTGGTTGGCCACCGGGCTGCCGTCAATGTAGTAGACTTTGACGACAAGTACATCGTGTCTGCCT
CTGGTGACAGGACCATCAAAGTCTGGAGCACGAGCACCTGTGAATTTGTTCGTACTCTCAATGGGCACAA
GCGGGGCATTGCCTGTCTCCAGTACAGGGATCGCCTGGTTGTTAGTGGATCATCAGATAATACCATTAGG
CTCTGGGATATTGAATGTGGTGCCTGTTTAAGAGTCCTAGAGGGACATGAAGAATTGGTCCGATGCATCC
GGTTTGATAACAAGAGGATTGTCAGTGGGGCCTATGATGGGAAAATTAAAGTTTGGGACTTGCAAGCTGC
TCTTGACCCTCGAGCCCCAGCAAGCACATTGTGTTTGCGCACATTGGTGGAACATTCTGGACGTGTGTTT
CGGCTCCAGTTTGATGAGTTTCAGATCATCAGCAGCTCCCATGATGACACTATTTTGATTTGGGATTTCT
TAAATGTGCCTCCCAGTGCCCAGAATGAGACCCGTTCTCCCTCCAGAACATACACTTACATCTCTAGATA
ACAGTCTGCACTTTCACCCGTTTCAGGGTTTTCTAGTCTTGAACTACTGGCTACGTGGCTACCAAATGCC
TAAGGGAGTTCGTTCACAGCTGAGTTATGAAGCTGGAATTGGTTCTAGACGCTGGGTAGATGCAAAGCAG
CCTAACTCTTCAAGTACCGACATTTCTCACCTCTGATTCCGGCTCTCCTTTGAGAAGGAGACCTTAGCTT
CCCCGGCTTCAAGTAGAACAGAAGCCCGTTTCCTTCCCTCATCAGTGAAAAAATCTAATGTTTCAAATGT
AAATTGTTCATAGAAAAGGAACATAGAATCTGTTTTACAGAAGTAAATCGACCGTCAAGAGAAGACTTGG

Figure 20 (Continued)

```
CCTCTAATTTATATTGCTTTGCACTTTGGTTTGATATTAAGAAACAGCATTCTTCTTCAGTGAAATTTTG
GGTGCCAAACACCTACCCAGAATGTCCAGGGCTTTCATTTTCAAAAGTTAGCATTCTCCTTTTGACCGTC
CAAGTCATTATGAATTCTGACTTGTTGTATTAGGAACATGTTGGACAGTGGAAAATTTTCTCTGGATTGT
TTTAGTAATATTTTTGGGATTATACTTCCTTTCTGTACCAATTTCTTTTAATTTAAAGAACTATAAGTCA
GTTATATTATCTACCAACAGGTAATATAGCTCTTTCTTTTATTAACTGTTCTCTGTCCCCCAACCATCTC
CTGATATTTGGTAGAGTAACACCTTTATACGTGTGCTTGCCTCCTAATTTAAAATACTGTATTCGCATGT
AGATATAATGTACATAACAGTTTAACCTCAAAGTTGCTGGAGTCAGGGCCCCCTGTGCTTGAGACACTAA
TACAGAGTGTGTTCGCACTTAGCCATGGGCTGGGCTCAAGAACCTGATACCTGGGTTGATGTGGATTACC
TAGAACCCTTCCTGCAGTATTCATACAGTGTTTTTATTTTGTTGTTGTCATTGCGTGTGTGTGGTTTGTG
TGTGTTTTTAATGAGAATCTTGTTTTAAAATGTAATTTCTAAGGTTTAACACCAAAATGTTTTATTTGTT
GTGGAGTATATATTATACAATAGAGAGGTACCTTAAACATTTTTGTTCTTATTCTTTTTCTCATAAGTA
CTCCTGAGTACAAGTGGTCACCTCCCATAGTATTCATTTGGCTTCGCTGTCAAAAATCATTATTCTGTGC
AGTCGTGGCCCTGGGAAGGGGAAATAAGAAGGCCCTGTTGACGGGCTGTCTTGGCTCTGGAATTCATGCA
TCCTGGCCTTGCCAAGGTTCTGGCAGGGCCTGCTGGTGTGTTGGAGCCTGCAGGGCAGGTCAGGCTGGTT
CAGAGGCCCATGCTGAGGGGTGGGTGCTCTGAAGTGGAGTGAAGCCTCAAGCCCATGAATGCCACCCCAG
TCATCTCTGGTGTCAGCTGCTGCTGTGGCCCCAGCAGGTTCTCAAAGCTCCCAAGTCCTCCCTACGACAC
AGCCCAAATGTGTAAATGGCACTGTTGCCCTGACAGTGCATGGAAAGGACGTTGGCATCCAATTGGCACT
CCTTCTCCCTTATTCAATATTAGGTTTGATTTGCCCTTCGCCATTGTTTCCAAAGATCAAGGAATGTCAA
TAACATTTTAAAGGACCAATAAACAGCCTCCTATAAAGTAAACCTCTTCCCGTGGAAGCACACTCTACTA
CTAAAGGGAAGGCCCCTGGGCTCTGATTTGTCCTTTGCATTGAGAACGGTGTGGGGATCAGTGTGTGTGT
ATGTGATTTGTTTATTGAGTTGGCTTTGCTTTTTTAGTTTTTCTTTTAAAAATAAAATCCTTCCTTCCCA
TGTTACTAAATTAATTTATGTTTTTGAGAGGTTGAGTCTCAAAGTGTAAACAATAAACCTCCATTCATAA
GGTGGATGTTGTAAGCTTGATGGTGGTTGTGAAAGTGATTTAGCTTTGACCACTTTTCATCCTACAGCTT
CAATATCAAACTGGTTAGGAAAGCCCAGGGGGAAGGGAGGGGGCAGGGGAGGAGGCAATTCTGAATGAAT
GAATGGATTTTTTGTTGTTTTGCATGTTTAATATAGAAGTTCCCCTCGTTCCTTGGGAGATGATGGCCT
TTGAATATGCAGACAACCTTTGAATTGTGCCTACTAAATTATAGCAGGGGACTTTGGCACCCAAGGAGTT
CTGACTTTCTGGGATTATAATAGTAATTCCCAGCCATACTCTGGACTTTATTTTGCTAACCATAACTGAG
CAAATGTAAATTACTGCTATATTAATGTTTTAAAGCACTGGGATAGTCTAATTCTAACTTGTAATTAATT
ATGTTTGCCAATTATCTGTTTGAAATAAATTTGTGTCTGAACAGCTATTGAAACTGTTAAATTGTACAGA
TATTATTCATGACAGCTTTGTACTGTGGAATGTGCTTAATAAAAAAAAAAAAAAA

>gi|20379717|gb|BC027911.1| Homo sapiens jumonji domain containing 5, mRNA (cDNA
clone MGC:34163 IMAGE:5207043), complete cds
CGAGCGGTGAGCGATCGATACTCCTATGCTAGCCTCTGGCTCCTCAGGGGACACAGCCGAGTGGTCGGAC
CAAACGCAACGAGTCTTCGCCAGCCCAAAGGCGACTCGACACCGTCCCAGCTGAAGAGAGGCACGGGACT
GAACCAGCTGGTGGTGGCCCGATGGCTGGAGACACCCACTGCCCCGCAGAGCCCCTGGCCAGAGAAGGCA
CTTTATGGGAGGCCCTCAGGGCGCTCCTGCCGCACAGTAAAGAAGACCTGAAGTTGGACCTCGGGGAGAA
AGTGGAGAGGAGCGTGGTGACATTGTTGCAGCGAGCCACTGAGCTCTTCTACGAGGGCAGGAGGGACGAG
TGTCTGCAGAGCAGCGAGGTGATCCTGGACTACTCCTGGGAGAAGCTCAACACGGGCACATGGCAGGACG
TAGACAAAGACTGGCGCCGGGTCTACGCCATCGGCTGCCTCCTGAAAGCCCTGTGTCTGTGCCAGGCACC
TGAGGATGCCAACACTGTGGCCGCAGCCCTGCGGGTCTGTGACATGGGCCTGCTGATGGGGCAGCCATC
CTGGGGGACATCCTTCTTAAAGTCGCTGCCATCCTCCAGACACACCTCCCTGGAAAGAGGCCTGCCCGTG
```

Figure 20 (Continued)

```
GCTCCCTCCCAGAGCAACCCTGCACAAAGAAAGCAAGGGCGGACCATGGTTTGATTCCAGATGTGAAGTT
AGAAAAAACAGTCCCCCGGCTGCACCGTCCGTCCCTCCAGCATTTCAGGGAGCAGTTTTTGGTTCCAGGG
AGGCCCGTGATCCTGAAAGGCGTGGCTGACCACTGGCCGTGCATGCAGAAGTGGAGTTTGGAGTATATCC
AGGAGATCGCTGGCTGCCGAACTGTCCCAGTGGAAGTTGGTTCGAGGTACACAGATGAGGAATGGTCCCA
GACCCTCATGACGGTCAACGAGTTCATCAGCAAATACATCGTGAATGAGCCAAGGGACGTCGGGTACCTT
GCTCAGCACCAGCTCTTTGACCAGATCCCGGAGTTGAAGCAGGACATCAGCATCCCCGACTACTGCAGCC
TGGGCGATGGGGAGGAGGAGGAAATCACCATCAATGCCTGGTTTGGTCCCCAGGGAACCATCTCCCCACT
ACATCAGGATCCCCAGCAAAACTTCCTAGTGCAGGTGATGGGGAGGAAGTACATCCGGCTGTATTCCCCG
CAGGAGTCAGGGGCTCTGTACCCTCATGACACGCACCTTCTCCATAACACGAGCCAGGTTGACGTGGAGA
ATCCCGACCTGGAAAAGTTCCCCAAGTTTGCCAAGGCCCCATTCCTGTCCTGCATCCTGTCTCCTGGAGA
GATCCTGTTCATCCCGGTGAAATACTGGCATTACGTGCGGGCTCTGGATTTGAGCTTCTCGGTCAGCTTC
TGGTGGTCGTAGCCAGGATAGGAGCTGAAAGGCCTGACATGCAGACAGCATTCATCTGTTCACTAATTT
CCTGGGTCCTGGAATCTATAGAGACAAGCAGGACTGAACCTGTGTCCTGAAGAGCCTTCACTGCCCAGTG
GCAGCCCTGGGGGGCTGAGCTCCAGCACTGGACAGGCACAGAGCAGGGCTGCCCAGGAAGGAGCACACT
CCAGGCCAGGGGTGCATGGCAGAGGAAGGTGGGGAGAGCCCAGAAGGACATTGCAGACAGACAGCCTGCA
TGGGGACTCTGGCATCAGAAAGCCGAATGTTTTTGGGAAACGGGTGGGTCACACAGGCAGGGTGAAACA
TGGGCTCTGAGGTTGGCTACCTGATTCAAACCCGGCCGCGCTGCGCACCTGCTGGGTGACTTGGCCAGGA
TCCCCCACTTCGCTGTGCCCATATGGAAAAGAGGGCAAGGCCAGTCCTCACTGCCGAGGGCCGAGAAGGC
GGTGCCGAGCCCCTGCTGCTGCATGAACCTTAGCCGCTGTCACTGATCCCAATTACTCTGATCCTTTTGC
CCTTCCTTCCCATAACGGCCTGCTGGACGCCACAGCCTGAATACTGGAGAGAGCTGGGCATTGCCCAGGT
CACAGGAGAGAGTCCGTAGAGACCTGCGCAGGAGCCGGGACCCCTGCTGAGCAGTGGGAGCTTTCTGTCA
TCCCCATGGCTCAAGGATAACCTACCTGCCTGCAGAGAAGAGCGAAGGTCTTGCTGGATGACTTTTCACC
CGCACTCACCCAGGAGCAGGCTCCCAAGTGAAGAAACCACCAAACCATCACCAGCTCCTAGAAGCCTCCC
TCCCACCACCTTCTAGTCACCATCCCCCAGAAGTAATGACTCTCAAACCTGGGGATTTGAGGCCAGGGG
GAGAGCCAGGCTCTATGCTTTCTGTAATTGTGTCTCGTTTGTGTGCACGCAGGTTTGTTTTATGTTTTGG
CCATTAAGATTTTCCCCAGCCAAAAAAAAAAAAAAAAAAAAAAAAAAAAAAAAAAAAAAAAAAAAAAAAA
AAA

>gi|34783469|gb|BC034488.2| Homo sapiens ATP-binding cassette, sub-family F
(GCN20), member 1, mRNA (cDNA clone MGC:26501 IMAGE:4826422), complete cds
AGCACCGGGCGCCGCCACAGTAGCTGTAACTGCCACCGCGATGCCGAAGGCGCCCAAGCAGCAGCCGCCG
GAGCCCGAGTGGATCGGGGACGGAGAGAGCACGAGCCCATCAGACAAAGTGGTGAAGAAAGGGAAGAAGG
ACAAGAAGATCAAAAAAACGTTCTTTGAAGAGCTGGCAGTAGAAGATAAACAGGCTGGGGAAGAAGAGAA
AGTGCTCAAGGAGAAGGAGCAGCAGCAGCAGCAACAGCAACAGCAGCAAAAAAAAAAGCGAGATACCCGA
AAAGGCAGGCGGAAGAAGGATGTGGATGATGATGGAGAAGAGAAAGAGCTCATGGAGCGTCTTAAGAAGC
TCTCAGTGCCAACCAGTGATGAGGAGGATGAAGTACCCGCCCAAAACCCCGCGGAGGGAAGAAAACCAA
GGGTGGTAATGTTTTGCAGCCCTGATTCAGGATCAGAGTGAGGAAGAGGAGGAGGAAGAAAAACATCCT
CCTAAGCCTGCCAAGCCGGAGAAGAATCGGATCAATAAGGCCGTACCTGAGGAACAGCAGCCTGCACTCA
AGGGCAAAAAGGGAAAGGAAGAGAAGTCAAAAGGGAAGGCTAAGCCTCAAAATAAATTCGCTGCTCTGGA
CAATGAAGAGGAGGATAAAGAAGAAGAAATTATAAAGGAAAAGGAGCCTCCCAAACAAGGGAAGGAGAAG
GCCAAGAAGGCAGAGCAGGGTTCAGAGGAAGAAGGAGAAGGGGAAGAAGAGGAGGAGGAAGGAGGAGAGT
CTAAGGCAGATGATCCCTATGCTCATCTTAGCAAAAAGGAGAAGAAAAAGCTGAAAAAACAGATGGAGTA
```

Figure 20 (Continued)

```
TGAGCGCCAAGTGGCTTCATTAAAAGCAGCCAATGCAGCTGAAAATGACTTCTCCGTGTCCCAGGCGGAG
ATGTCCTCCCGCCAAGCCATGTTAGAAAATGCATCTGACATCAAGCTGGAGAAGTTCAGCATCTCCGCTC
ATGGCAAGGAGCTGTTCGTCAATGCAGACCTGTACATTGTAGCCGGCCGCCGCTACGGGCTGGTAGGACC
CAATGGCAAGGGCAAGACCACACTCCTCAAGCACATTGCCAACCGAGCCCTGAGCATCCCTCCCAACATT
GATGTGTTGCTGTGTGAGCAGGAGGTGGTAGCAGATGAGACACCAGCAGTCCAGGCTGTTCTTCGAGCTG
ACACCAAGCGATTGAAGCTGCTGGAAGAGGAGCGGCGGCTTCAGGGACAGCTGGAACAAGGGGATGACAC
AGCTGCTGAGAGGCTAGAGAAGGTGTATGAGGAATTGCGGGCCACTGGGGCGGCAGCTGCAGAGGCCAAA
GCACGGCGGATCCTGGCTGGCCTGGGCTTTGACCCTGAAATGCAGAATCGACCCACACAGAAGTTCTCAG
GGGGCTGGCGCATGCGTGTCTCCCTGGCCAGGGCACTGTTCATGGAGCCCACACTGCTGATGCTGGATGA
GCCCACCAACCACCTGGACCTCAACGCTGTCATCTGGCTTAATAACTACCTCCAGGGCTGGCGGAAGACC
TTGCTGATCGTCTCCCATGACCAGGGCTTCTTGGATGATGTCTGCACTGATATCATCCACCTCGATGCCC
AGCGGCTCCACTACTATAGGGGCAATTACATGACCTTCAAAAAGATGTACCAGCAGAAGCAGAAAGAACT
GCTGAAACAGTATGAGAAGCAAGAGAAAAAGCTGAAGGAGCTGAAGGCAGGCGGGAAGTCCACCAAGCAG
GCGGAAAAACAAACGAAGGAAGCCCTGACTCGGAAGCAGCAGAAATGCCGACGGAAAAACCAAGATGAGG
AATCCCAGGAGGCCCCTGAGCTCCTGAAGCGCCCTAAGGAGTACACTGTGCGCTTCACTTTTCCAGACCC
CCCACCACTCAGCCCTCCAGTGCTGGGTCTGCATGGTGTGACATTCGGCTACCAGGGACAGAAACCACTC
TTTAAGAACTTGGATTTTGGCATCGACATGGATTCAAGGATTTGCATTGTGGGCCCTAATGGTGTGGGGA
AGAGTACGCTACTCCTGCTGCTGACTGGCAAGCTGACACCGACCCATGGGGAAATGAGAAAGAACCACCG
GCTGAAAATTGGCTTCTTCAACCAGCAGTATGCAGAGCAGCTGCGCATGGAGGAGACGCCCACTGAGTAC
CTGCAGCGGGGCTTCAACCTGCCCTACCAGGATGCCCGCAAGTGCCTGGGCCGCTTCGGCCTGGAGAGTC
ACGCCCACACCATCCAGATCTGCAAACTCTCTGGTGGTCAGAAGGCGCGAGTTGTGTTTGCTGAGCTGGC
CTGTCGGGAACCTGATGTCCTCATCTTGGACGAGCCAACCAATAACCTGGACATAGAGTCTATTGATGCT
CTAGGGGAGGCCATCAATGAATACAAGGGTGCTGTGATCGTTGTCAGCCATGATGCCCGACTCATCACAG
AAACCAATTGCCAGCTGTGGGTGGTGGAGGAGCAGAGTGTTAGCCAAATCGATGGTGACTTTGAAGACTA
CAAGCGGGAGGTGTTGGAGGCCCTGGGTGAAGTCATGGTCAGCCGGCCCCGAGAGTGAAGCTTTCCTTCC
CAGAAGTCTCCCGAGAGACATATTTGTGTGGCCTAGAAGTCCTCTGTGGTCTCCCCTCCTCTGAAGACTG
CCTCTGGCCTGCAGCTGACCTGGCAACCATTCAGGCACATGAAGGTGGAGTGTGACCTTGATGTGACCGG
GATCCCACTCTGATTGCATCCATTTCTCTGAAAGACTTGTTTGTTCTGCTTCTCTTCATATAACTGAGCT
GGCCTTATCCTTGGCATCCCCCTAAACAAACAAGAGGTGACCACCTTATTGTGAGGTTCCATCCAGCCAA
GTTTATGTGGCCTATTGTCTCAGGACTCTCATCACTCAGAAGCCTGCCTCTGATTTACCCTACAGCTTCA
GGCCCAGCTGCCCCCAGTCTTTGGGTGGTGCTGTTCTTTTCTGGTGGATTTAATGCTGACTCACTGGTA
CAAACAGCTGTTGAAGCTCAGAGCTGGAGGTGAGCTTCTGAGGCCTTTGCCATTATCCAGCCCAAGATTT
GGTGCCTGCAGCCTCTTGTCTGGTTGAGGACTTGGGGCAGGAAAGGAATGCTGCTGAACTTGAATTTCCC
TTTACAAGGGGAAGAAATAAAGGAAAGGAGTTGCTGCCAAAAAAAAAAAAAAAA

>gi|23273580|gb|BC036089.1| Homo sapiens myeloid/lymphoid or mixed-lineage
leukemia (trithorax homolog, Drosophila); translocated to, 3, mRNA (cDNA clone
MGC:33789 IMAGE:5298142), complete cds
GCTCCGCAATCATCTTCTTTACCCTGGAGCTGCTGCTGCTGCTGCTGCTTTTGCTTTTGGGGCTGAGTTT
AATAAGCGAGCGAGCGAGCAAGCGAGCGCGGGGGAAAAAGGCAGAGAATGTCCGCCATCTACCCTCCGC
TCCTGGGCGCGCTCTCATTCATAGCAGCCTCTTCATGAATTACAGCTGAGGGGGGGCGGAGGAGGGGGGG
GTACCACACAACACCCCAGCAAACCTCCGGGCCCCCAGGCATGGCTAGCTCGTGTGCCGTGCAGGTGAAG
```

Figure 20 (Continued)

```
CTGGAGCTGGGGCACCGCGCCCAGGTGAGGAAAAAACCCACCGTGGAGGGCTTCACCCACGACTGGATGG
TGTTCGTACGCGGTCCGGAGCACAGTAACATACAGCACTTTGTGGAGAAAGTCGTCTTCCACTTGCACGA
AAGCTTTCCTAGGCCAAAAAGAGTGTGCAAAGATCCACCTTACAAAGTAGAAGAATCTGGGTATGCTGGT
TTCATTTTGCCAATTGAAGTTTATTTTAAAAACAAGGAAGAACCTAGGAAAGTCCGCTTTGATTATGACT
TATTCCTGCATCTTGAAGGCCATCCACCAGTGAATCACCTCCGCTGTGAAAAGCTAACTTTCAACAACCC
CACAGAGGACTTTAGGAGAAAGTTGCTGAAGGCAGGAGGGGACCCTAATAGGAGTATTCATACCAGCAGC
AGCAGCAGCAGCAGCAGTAGCAGCAGCAGCAGCAGCAGCAGCAGCAGCAGTAGCAGCAGCAGCGGCA
GCAGCAGCAGTAGCAGCAGCAGTAGCAGCAGCAGCAGCAGTAGTACCAGTTTTTCAAAGCCTCA
CAAATTAATGAAGGAGCACAAGGAAAAACCTTCTAAAGACTCCAGAGAACATAAAAGTGCCTTCAAAGAA
CCTTCCAGGGATCACAACAAATCTTCCAAAGAATCCTCTAAGAAACCCAAAGAAAATAAACCACTGAAAG
AAGAGAAAATAGTTCCTAAGATGGCCTTCAAGGAACCTAAACCCATGTCAAAAGAGCCAAAACCAGATAG
TAACTTACTCACCATCACCAGTGGACAAGATAAGAAGGCTCCTAGTAAAAGGCCGCCCATTTCAGATTCT
GAAGAACTCTCAGCCAAAAAAGGAAAAAGAGTAGCTCAGAGGCTTTATTTAAAAGTTTTTCTAGCGCAC
CACCACTGATACTCACTTGTTCTGCTGACAAAAAACAGATAAAAGATAAATCTCATGTCAAGATGGGAAA
GGTCAAAATTGAAAGTGAGACATCAGAGAAGAAGAAATCAACGTTACCGCCATTTGATGATATTGTGGAT
CCCAATGATTCAGATGTGGAGGAGAATATATCCTCTAAATCTGATTCTGAACAACCCAGTCCTGCCAGCT
CCAGCTCCAGCTCCAGCTCCAGCTTCACACCATCCCAGACCAGGCAACAAGGTCCTTTGAGGTCTATAAT
GAAAGATCTGCATTCTGATGACAATGAGGAGGAATCAGATGAAGTGGAGGATAACGACAATGACTCTGAA
ATGGAGAGGCCTGTAAATAGAGGAGGCAGCCGAAGTCGCAGAGTTAGCTTAAGTGATGGCAGCGATAGTG
AAAGCAGTTCTGCTTCTTCACCCCTACATCACGAACCTCCACCACCCTTACTAAAAACCAACAACAACCA
GATTCTTGAAGTGAAAAGTCCAATAAAGCAAAGCAAATCAGATAAGCAAATAAAGAATGGTGAATGTGAC
AAGGCATACCTAGATGAACTGGTAGAGCTTCACAGAAGGTTAATGACATTGAGAGAAAGACACATTCTGC
AGCAGATCGTGAACCTTATAGAAGAAACTGGACACTTTCATATCACAAACACAACATTTGATTTTGATCT
TTGCTCGCTGGACAAAACCACAGTCCGTAAACTACAGAGTTACCTGGAAACATCTGGAACATCCTGAGGA
TATAACAACTGGATGCATCAAGAACTATTGTGTTTTTTTTTTGGTTTTTTTTTTTTTGGTTGTGAT
TTTTTGTTCTTGTTGTTTATATGAAAACACTCAAAATGATGCAACCAAAAGGGAAAAAATAAAAATCAAA
CAACCTCCAAAAAAAAAAAAAAAA

>gi|24416468|gb|BC038838.1| Homo sapiens proline rich 16, mRNA (cDNA clone
MGC:47873 IMAGE:5170587), complete cds
GGAAACAGTGCTGCAGGCATACAGTGACAACAGGACATCAGGAAATGCCCAAGAAGTTTGTTAGGTGCTG
TGTCATGAATCAAGTCTTCATTTTAATGTGTTCTAATTGTTGTAAAACAAGAGGGAATGGTATTTGGAAT
TTAGCTATATTTATCTTCTCAATCAAATTCTACTTCAGAGGTGGTTGACCAGATTGACACCCTGACCTCT
GACCTACAGCTGGAGGATGAGATGACTGACAGCTCCAAAACGGACACGCTGAATAGTAGCTCAAGTGGCA
CAACAGCCTCCAGCCTAGAGAAGATCAAAGTGCAGGCTAATGCACCGCTTATTAAACCCCCAGCACACAC
ATCTGCTATCCTCACGGTCCTGAGAAAGCCAAACCCTCCACCACCTCCTCCAAGGTTGACACCTGTGAAG
TGTGAAGACCCCAAAAGGGTGGTTCCAACTGCCAATCCTGTAAAAACCAATGGCACCCTTCTACGAAATG
GAGGCTTACCAGGTGGACCTAACAAAATTCCAAATGGAGATATCTGCTGCATACCCAACAGTAACTTGGA
CAAGGCTCCAGTCCAGCTTCTGATGCATAGACCTGAAAAAGACAGATGTCCCCAGGCAGGGCCTCGAGAA
CGAGTTCGGTTTAATGAAAAAGTACAGTACCATGGCTATTGTCCTGACTGTGATACCCGGTATAACATAA
AAAACAGGGAGGTCCACTTACACAGTGAACCTGTCCACCCACCGGGAAGATTCCTCACCAAGGCCCTCC
CCTCCCTCCTACACCCCATCTCCCTCCTTTCCCACTAGAAAATGGGGGAATGGGAATAAGCCACAGTAAC
```

Figure 20 (Continued)

AGCTTCCCCCCTATCAGACCTGCAACTGTGCCTCCTCCCACTGCACCAAAACCACAGAAGACGATCTTGA
GGAAGTCAACCACTACAACCGTGTGATGTATGCCATTAAAAAAATTGTTTTTTTAATTTTCTATATTATA
AACATAAAATAAGTAATGAGCACTTTCTACTCAAGCAATAAAAAGCCCAAATATATTAATCCTGCATTCA
GCAAAGTGGCATAAAAATCACCTGGTAAGTATGCAGCACATTGCTTATATCCTGGGTATGCATTATTTTA
AATGTTGTATCATTAAAAACCTCAGAATGATGAAAAAAAAAAAAAAAAAAAAAAAAAAAAAAAAAAAAAA
AAAAAAAAAAAAAAAAAAAAAAAAAAAAAA

>gi|27469814|gb|BC041831.1| Homo sapiens transducin-like enhancer of split 3
(E(sp1) homolog, Drosophila), mRNA (cDNA clone MGC:43497 IMAGE:5268249), complete
cds AATTCCGCGCGAGTGGCGCGGGGGGCTGCTTGTGTTCCAGGGGGAGCTGTTCACGCGGTCCCCGGCCCCG
CTCTGAAGTCTCCCAACTCACCCGGCTTGTCTCCCGCCCCGCCTTACTGGGGAGAGGGAGGCCCTTGGT
GAAAGGCATGGGAGCCCCGCTGCCGACGGGGAGAGATGGGGCGCCCCCCCTCCGCCCCGTCGGAGAGCTG
AGAAACTTGCTGGGAAGGTTCTGGGCTGAGGGTGGCCTCTTTTGGTTGGGCGCCGTTGGGGAGGGGCCGG
GGCCGCTCTGAGCGCGGTCTCATGCCCCCGCCCCTCCCCTGTCTTGTCTTCGCGGGCTCCAGGCTCCCC
ATCAACCCGGGCAGCCGGGATTTAAATTCACGGTGGCTGAGTCTTGTGACAGGATCAAAGACGAATTCCA
GTTCCTGCAAGCTCAGTATCACAGCCTCAAAGTGGAGTACGACAAGCTGGCAAACGAGAAGACGGAGATG
CAGCGCCATTATGTGATGTACTATGAGATGTCCTATGGCTTGAACATTGAAATGCACAAGCAGACAGAGA
TTGCGAAGAGACTGAACACAATTTTAGCACAGATCATGCCTTTCCTGTCACAAGAGCACCAGCAGCAGGT
GGCGCAGGCAGTGGAGCGCGCCAAGCAGGTCACCATGACGGAGCTGAACGCCATCATCGGGCAGCAGCTC
CAGGCGCAGCACCTCTCCCATGCCACACACGGCCCCCCGGTCCAGTTGCCACCCCACCCGTCAGGTCTCC
AGCCTCCAGGAATCCCCCCAGTGACAGGGAGCAGCTCCGGGCTGCTGGCACTGGGCGCCCTGGGCAGCCA
GGCCCATCTGACGGTGAAGGATGAGAAGAACCACCATGAACTCGATCACAGAGAGAGAGAATCCAGTGCG
AATAACTCTGTGTCACCCTCGGAAAGCCTCCGGGCCAGTGAGAAGCACCGGGGCTCTGCGGACTACAGCA
TGGAAGCCAAGAAGCGGAAGGCGGAAGAGAAGGACAGCTTGAGCCGATACGACAGTGATGGGGACAAGAG
TGATGATCTGGTGGTGGATGTTTCCAATGAGGACCCCGCAACGCCCCGGGTCAGCCCGGCACACTCCCCT
CCTGAAAATGGGCTGGACAAGGCCCGTAGCCTGAAAAAAGATGCCCCCACCAGCCCTGCCTCGGTGGCCT
CTTCCAGTAGCACACCTTCCTCCAAGACCAAAGACCTTGGTCATAACGACAAATCCTCCACCCCTGGGCT
CAAGTCCAACACACCAACCCCAAGGAACGACGCCCCAACTCCAGGCACCAGCACGACCCCAGGGCTCAGG
TCGATGCCGGGTAAACCTCCGGGCATGGACCCGATAGGTATAATGGCCTCGGCTCTGCGCACGCCCATCT
CCATCACCAGCTCCTATGCGGCGCCCTTCGCCATGATGAGCCACCATGAGATGAACGGCTCCCTCACCAG
TCCTGGCGCCTACGCCGGCCTCCACAACATCCCACCCCAGATGAGCGCCGCCGCCGCTGCTGCAGCCGCT
ACCTATGGCCGATCGCCAATGGTTGGTTTTGACCCTCACCCCCCGATGCGGGCCACAGGCCTCCCCTCAA
GCCTGGCCTCCATTCCTGGAGGAAAACCAGCGTACTCATTCCATGTGAGTGCTGATGGGCAGATGCAGCC
CGTGCCCTTCCCCCACGACGCCCTGGCAGGCCCCGGCATCCCGAGGCACGCCCGGCAGATCAACACACTC
AGCCACGGGGAGGTGGTGTGTGCCGTGACCATCAGCAACCCCACGAGGCACGTCTACACAGGTGGCAAGG
GCTGCGTGAAGATCTGGGACATCAGCCAGCCAGGCAGCAAGAGCCCCATCTCCCAGCTGGACTGCCTGAA
CAGGGACAATTACATCCGCTCCTGCAAGCTGCTCCCTGATGGGCGCACGCTCATCGTGGGCGGCGAGGCC
AGCACGCTCACCATCTGGGACCTGGCCTCACCCACGCCCCGCATCAAGGCCGAGCTGACGTCCTCGGCTC
CCGCCTGTTATGCCCTGGCCATTAGCCCTGACGCCAAAGTCTGCTTCTCCTGCTGCAGCGATGGGAACAT
TGCTGTCTGGGACCTGCACAACCAGACCCTGGTCAGGCAGTTCCAGGGCCACACAGATGGGGCCAGCTGC
ATAGACATCTCCCATGATGGCACCAAACTGTGGACAGGGGGCCTGGACAACACAGTGCGCTCCTGGGACC

Figure 20 (Continued)

```
TGCGGGAGGGCCGACAGCTACAGCAGCATGACTTCACTTCCCAGATCTTCTCGCTGGGCTACTGCCCCAC
TGGGGAGTGGCTGGCTGTGGGCATGGAGAGCAGCAACGTGGAGGTGCTGCACCACACCAAGCCTGACAAG
TACCAGCTGCACCTGCACGAGAGCTGCGTGCTCTCCCTCAAGTTCGCCTACTGCGGCAAGTGGTTCGTGA
GCACTGGGAAAGATAACCTTCTCAACGCCTGGAGGACGCCTTATGGAGCCAGCATATTCCAGTCTAAAGA
ATCCTCGTCTGTCTTGAGTTGTGACATTTCAGCGGATGACAAATACATTGTAACAGGCTCTGGTGACAAG
AAGGCCACAGTTTATGAGGTCATCTACTAAACAAGAACTCCAGCAGGGCTGTCAAACTCTGGGAGAAACC
GACTCGGCTCTGACAGGGAGACCCCCAGGCGAGGGGCCCCGAGGATGGCGGAGGATGGGCCGCAGGCAGC
CGAGCGTTCAGGGCTGCGCTCCGGCCGGCTGAGAGGGCACGTGCCCCGTCACAGTCTGGACTCCTGGGCC
TGGATTGATGTGTCTCACAGACTCGGAAGGGTTCTGCTCCTCCTCCTCCCCCTGAACAATGCTGGCAGTT
GCTACAAATAGATTTATTGGAGGCTTATGGCTCCGGTTCCCCACAAAAAAAAAAAAAAAAA

>gi|29792267|gb|BC050616.1| Homo sapiens tumor suppressing subtransferable
candidate 4, mRNA (cDNA clone MGC:60084 IMAGE:5744058), complete cds
CCCTCCTCTTCCTGTTCTTGGTCAATTCCGGTCTTGTTTCCCCAACAAATGCCGTCGTTTCCGGGGCTGC
TTCCGAGCCGGACCCAAGGGCCGGGGCGTGGAGGAGTAGAGGGGCGAGCGCATGCGCACAGGACTACACG
TCCCGACAGGCGTCGGGAGCGGCGGCCCAGTTCCTTGTGGGAGCTGTAGTTCTGCAGGCGCGGAAGCCGT
GGTGCTCGGCCGGCAGAGCACTCGGTTTCCCAGAGGGCTGAGCGCGCCGCACGGAGGTGCGGCGCCGACC
AAGATGGAGACTGCCGAGCAGCCTTGAGCCGTTGAGCAGCTGAACAGAGGCCATGCCGGGGCACTCCGAG
GCCTGAGACGACCACGCCTGTGCCGCTGAGGACCTTCATCAGGGCTCCGTCCACTTGGCCCGCTTGGCTG
TCCAATCACACTCCAGTGTCAACCACTGGCACCCAGCAGCCAAGAGAGGTGTGGCGTGGCCCTGGGGACG
CATGGCTGAGGCAGGAACAGGCCTCCTCCCAGCCACGGTGCAGCCATTCCATCTGAGAGGCATGAGCTCC
ACCTTCTCCCAGCGCAGCCGTGACATCTTTGACTGCCTGGAGGGGCGGCCAGACGGGCTCCATCCTCTG
TGGCCCACACCAGCATGAGTGACAACGGAGGCTTCAAGCGGCCCCTAGCGCCCTCAGGCCGGTCTCCAGT
GGAAGGCCTGGGCAGGGCCCATCGGAGCCCTGCCTCACCAAGGGTGCCTCCGGTCCCCGACTACGTGGCA
CACCCCGAGCGCTGGACCAAGTACAGCCTGGAAGATGTGACCGAGGTCAGCGAGCAGAGCAATCAGGCCA
CCGCCCTGGCCTTCCTGGGCTCCCAGAGCCTGGCTGCCCCCACTGACTGCGTGTCCTCCTTCAACCAGGA
TCCCTCCAGCTGTGGGGAGGGGAGGGTCATCTTCACCAAACCAGTCCGAGGGGTCGAAGCCAGACACGAG
AGGAAGAGGGTCCTGGGGAAGGTGGGAGAGCCAGGCAGGGGCGGCCTTGGGAATCCTGCCACAGACAGGG
GCGAGGGCCCTGTGGAGCTGGCCCATCTGGCCGGGCCCGGGAGCCCAGAGGCTGAGGAGTGGGGCAGCCC
CCATGGAGGCCTGCAGGAGGTGGAGGCACTGTCAGGGTCTGTCCACAGTGGGTCTGTGCCAGGTCTCCCG
CCGGTGGAAACTGTTGGCTTCCATGGCAGCAGGAAGCGGAGTCGAGACCACTTCCGGAACAAGAGCAGCA
GCCCCGAGGACCCAGGTGCTGAGGTCTGAGAGGGAGATGGCCCAGCCTGACCCCACTGGCCACTGCCATC
CTGCTGCCTTCCCAGTGGGGCTGGTCAGGGGGCAGCCTGGCCACTGCCTAGCTGGAATGGGAGGAAGCCT
GCAGGTGGCACCGGTGGCCCTGGCTGCAGTTCTGGGCAGCATCCTCCCAAGCAGAGACCTTGCTGAAGCT
CCTGGGGTGTGGGGTGTGGGCTGGAAGCACTGGCTCCCTGGTAGGGACAATAAAGGTTTTGGGTCTTTCT
GAAAAAAAAAAAAAAAAAAAAAAAAAAAAAAAAAAAAAAAAAAAAAAAAA >gi|31753080|gb|BC053895.1| Homo sapiens insulin receptor substrate 1, mRNA (cDNA
clone MGC:61462 IMAGE:6144252), complete cds
GGTTGTTTTTCGGAGCCTCCCTCTGCTCAGCGTTGGTGGTGGCGGTGGCAGCATGGCGAGCCCTCCGGAG
AGCGATGGCTTCTCGGACGTGCGCAAGGTGGGCTACCTGCGCAAACCCAAGAGCATGCACAAACGCTTCT
TCGTACTGCGCGCGGCCAGCGAGGCTGGGGGCCCGGCGCGCCTCGAGTACTACGAGAACGAGAAGAAGTG
```

Figure 20 (Continued)

```
GCGGCACAAGTCGAGCGCCCCCAAACGCTCGATCCCCCTTGAGAGCTGCTTCAACATCAACAAGCGGGCT
GACTCCAAGAACAAGCACCTGGTGGCTCTCTACACCGGGACGAGCACTTTGCCATCGCGGCGGACAGCG
AGGCCGAGCAAGACAGCTGGTACCAGGCTCTCCTACAGCTGCACAACCGTGCTAAGGGCCACCACGACGG
AGCTGCGGCCCTCGGGGCGGGAGGTGGTGGGGGCAGCTGCAGCGGCAGCTCCGGCCTTGGTGAGGCTGGG
GAGGACTTGAGCTACGGTGACGTGCCCCCAGGACCCGCATTCAAAGAGGTCTGGCAAGTGATCCTGAAGC
CCAAGGGCCTGGGTCAGACAAAGAACCTGATTGGTATCTACCGCCTTTGCCTGACCAGCAAGACCATCAG
CTTCGTGAAGCTGAACTCGGAGGCAGCGGCCGTGGTGCTGCAGCTGATGAACATCAGGCGCTGTGGCCAC
TCGGAAAACTTCTTCTTCATCGAGGTGGGCCGTTCTGCCGTGACGGGCCCGGGGAGTTCTGGATGCAGG
TGGATGACTCTGTGGTGGCCCAGAACATGCACGAGACCATCCTGGAGGCCATGCGGGCCATGAGTGATGA
GTTCCGCCCTCGCAGCAAGAGCCAGTCCTCGTCCAACTGCTCTAACCCCATCAGCGTCCCCCTGCGCCGG
CACCATCTCAACAATCCCCCGCCCAGCCAGGTGGGGCTGACCCGCCGATCACGCACTGAGAGCATCACCG
CCACCTCCCCGGCCAGCATGGTGGGCGGGAAGCCAGGCTCCTTCCGTGTCCGCGCCTCCAGTGACGGCGA
AGGCACCATGTCCCGCCCAGCCTCGGTGGACGGCAGCCCTGTGAGTCCCAGCACCAACAGAACCCACGCC
CACCGGCATCGGGGCAGCGCCCGGCTGCACCCCCCGCTCAACCACAGCCGCTCCATCCCCATGCCGGCTT
CCCGCTGCTCGCCTTCGGCCACCAGCCCGGTCAGTCTGTCGTCCAGTAGCACCAGTGGCCATGGCTCCAC
CTCGGATTGTCTCTTCCCACGGCGATCTAGTGCTTCGGTGTCTGGTTCCCCAGCGATGGCGGTTTCATC
TCCTCGGATGAGTATGGCTCCAGTCCCTGCGATTTCCGGAGTTCCTTCCGCAGTGTCACTCCGGATTCCC
TGGGCCACACCCCACCAGCCCGCGGTGAGGAGGAGCTAAGCAACTATATCTGCATGGGTGGCAAGGGGCC
CTCCACCCTGACCGCCCCCAACGGTCACTACATTTTGTCTCGGGGTGGCAATGGCCACCGCTGCACCCCA
GGAACAGGCTTGGGCACGAGTCCAGCCTTGGCTGGGGATGAAGCAGCCAGTGCTGCAGATCTGGATAATC
GGTTCCGAAAGAGAACTCACTCGGCAGGCACATCCCCTACCATTACCCACCAGAAGACCCCGTCCCAGTC
CTCAGTGGCTTCCATTGAGGAGTACACAGAGATGATGCCTGCCTACCCACCAGGAGGTGGCAGTGGAGGC
CGACTGCCGGGACACAGGCACTCCGCCTTCGTGCCCACCCGCTCCTACCCAGAGGAGGGTCTGGAAATGC
ACCCCTTGGAGCGTCGGGGGGGGCACCACCGCCCAGACAGCTCCACCCTCCACACGGATGATGGCTACAT
GCCCATGTCCCCAGGGGTGGCCCCAGTGCCCAGTGGCCGAAAGGGCAGTGGAGACTATATGCCCATGAGC
CCCAAGAGCGTATCTGCCCCACAGCAGATCATCAATCCCATCAGACGCCATCCCCAGAGAGTGGACCCCA
ATGGCTACATGATGATGTCCCCCAGCGGTGGCTGCTCTCCTGACATTGGAGGTGGCCCCAGCAGCAGCAG
CAGCAGCAGCAACGCCGTCCCTTCCGGGACCAGCTATGGAAAGCTGTGGACAAACGGGGTAGGGGCCAC
CACTCTCATGTCTTGCCTCACCCCAAACCCCCAGTGGAGAGCAGCGGTGGTAAGCTCTTACCTTGCACAG
GTGACTACATGAACATGTCACCAGTGGGGACTCCAACACCAGCAGCCCTCCGACTGCTACTACGGCCC
TGAGGACCCCCAGCACAAGCCAGTCCTCTCCTACTACTCATTGCCAAGATCCTTTAAGCACACCCAGCGC
CCCGGGGAGCCGGAGGAGGGTGCCCGGCATCAGCACCTCCGCCTTTCCACTAGCTCTGGTCGCCTTCTCT
ATGCTGCAACAGCAGATGATTCTTCCTCTTCCACCAGCAGCGACAGCCTGGGTGGGGGATACTGCGGGGC
TAGGCTGGAGCCCAGCCTTCCACATCCCCACCATCAGGTTCTGCAGCCCATCTGCCTCGAAAGGTGGAC
ACAGCTGCTCAGACCAATAGCCGCCTGGCCCGGCCCACGAGGCTGTCCCTGGGGGATCCCAAGGCCAGCA
CCTTACCTCGGGCCCGAGAGCAGCAGCAGCAGCAGCCCTTGCTGCACCCTCCAGAGCCCAAGAGCCC
GGGGGAATATGTCAATATTGAATTTGGGAGTGATCAGTCTGGCTACTTGTCTGGCCCGGTGGCTTTCCAC
AGCTCACCTTCTGTCAGGTGTCCATCCCAGCTCCAGCCAGCTCCCAGAGAGGAAGAGACTGGCACTGAGG
AGTACATGAAGATGGACCTGGGGCCGGGCCGGAGGGCAGCCTGGCAGGAGAGCACTGGGGTCGAGATGGG
CAGACTGGGCCCTGCACCTCCCGGGGCTGCTAGCATTTGCAGGCCTACCCGGGCAGTGCCCAGCAGCCGG
GGTGACTACATGACCATGCAGATGAGTTGTCCCCGTCAGAGCTACGTGGACACCTCGCCAGCTGCCCCTG
TAAGCTATGCTGACATGCGAACAGGCATTGCTGCAGAGGAGGTGAGCCTGCCCAGGGCCACCATGGCTGC
```

Figure 20 (Continued)

```
TGCCTCCTCATCCTCAGCAGCCTCTGCTTCCCCGACTGGGCCTCAAGGGGCAGCAGAGCTGGCTGCCCAC
TCGTCCCTGCTGGGGGGCCCACAAGGACCTGGGGGCATGAGCGCCTTCACCCGGGTGAACCTCAGTCCTA
ACCGCAACCAGAGTGCCAAAGTGATCCGTGCAGACCCACAAGGGTGCCGGCGGAGGCATAGCTCCGAGAC
TTTCTCCTCAACACCCAGTGCCACCCGGGTGGGCAACACAGTGCCCTTTGGAGCGGGGGCAGCAGTAGGG
GGCGGTGGCGGTAGCAGCAGCAGCAGCGAGGATGTGAAACGCCACAGCTCTGCTTCCTTTGAGAATGTGT
GGCTGAGGCCTGGGGAGCTTGGGGGAGCCCCAAGGAGCCAGCCAAACTGTGTGGGGCTGCTGGGGGTTT
GGAGAATGGTCTTAACTACATAGACCTGGATTTGGTCAAGGACTTCAAACAGTGCCCTCAGGAGTGCACC
CCTGAACCGCAGCCTCCCCCACCCCCACCCCCTCATCAACCCCTGGGCAGCGGTGAGAGCAGCTCCACCC
GCCGCTCAAGTGAGGATTTAAGCGCCTATGCCAGCATCAGTTTCCAGAAGCAGCCAGAGGACCGTCAGTA
GCTCAACTGGACATCACAGCAGAATGAAGACCTAAATGACCTCAGCAAATCCTCTTCTAACTCATGGGTA
CCCAGACTCTAAATATTTCATGATTCACAACTAGGACCTCATATCTTCCTCATCAGTAGATGGTACGATG
CATCCATTTCAGTTTGTTTACTTTATCCAATCCTCAGGATTTCATTGACTGAACTGCACGTTCTATATTG
TGCCAAGCGAAAAAAAAAAATGCACTGTGACACCAGAATAATGAGTCTGCATAAACTTCATCTTCAACCT
TAAGGACTTAGCTGGCCACAGTGAGCTGATGTGCCCACCACCGTGTCATGAGAGAATGGGTTTACTCTCA
ATGCATTTTCAAGATACATTTCATCTGCTGCTGAAACTGTGTACGACAAAGCATCATTGTAAATTATTTC
ATACAAAACTGTTCACGTTGGGTGGAGAGAGTATTAAATATTTAACATAGGTTTTGATTTATATGTGTAA
TTTTTTAAATGAAAATGTAACTTTTCTTACAGCACATCTTTTTTTTGGATGTGGGATGGAGGTATACAAT
GTTCTGTTGTAAAGAGTGGAGCAAATGCTTAAAACAAGGCTTAAAAGAGTAGAATAGGGTATGATCCTTG
TTTTAAGATTGTAATTCAGAAAACATAATATAAGAATCATAGTGCCATAGATGGTTCTCAATTGTATAGT
TATATTTGCTGATACTATCTCTTGTCATATAAACCTGATGTTGAGCTGAGTTCCTTATAAGAATTAATCT
TAATTTGTATTTTTTCCTGTAAGACAATAGGCCATGTTAATTAAACTGAAGAAGGATATATTTGGCTGG
GTGTTTTCAAATGTCAGCTTAAAATTGGTAATTGAATGGAAGCAAAATTATAAGAAGAGGAAATTAAAGT
CTTCCATTGCATGTATTGTAAACAGAAGGAGATGGGTGATTCCTTCAATTCAAAAGCTCTCTTTGGAATG
AACAATGTGGGCGTTTGTAAATTCTGGAAATGTCTTTCTATTCATAATAAACTAGATACTGTTGATCTTT
TCTTCTGTCCCCTCCCCCCACCACTTCTGTAAGTTTCCTGCTCTATTCCCACCATTTTTTTCTGTGCACA
CATTATGATATATTTCATTTCCTGCATTGTCTTGAGAAAGATGGTAAGGCAAGTGAGCTGTTGCTAACCA
GAAATTAAAATTCCAGTAAGTGTTTTTCATTATGAAAAAAAAAAAAAAAAAAAAAAAAAAAAAAAAAAAA
AAAAAAAAA
```

```
>gi|32452021|gb|BC054520.1| Homo sapiens myocyte enhancer factor 2D, mRNA (cDNA
clone MGC:60395 IMAGE:6142751), complete cds
ATATCAACAACAGCCGAGGCGGCTCAGGCGCTCGGCCCCGGTTCCCCGCTTGCCTGCCGCCCGCCTGCTG
GCCCCGCGCCCACGACGGGGGCCCAGGCCTCACGGCGCCGCCCAGGGCCCGCGCGGACGCCGGCCTCAT
TTATTATTCTCCCCGCCCGGAGCTGCGGCTTCCCGGTGTTGAAGATCCCCCGGACCAGGGGCGAGGGCTA
CCCGCTCTTTGCCGTGACAACACCGTTCCCCCAGCCGGGCTGGAGGCTGTGCAGAAGGTATCCTGCAGAC
CATGAACTGAGCACTGTTCCCAGACCGTTCATGAGCACAGTGTAAGGTGTGCCGAGACCCACCACCCAGC
GAGCCCCTCCCCTCCGTAGCACTGAGGACCCCCGGAGAAGATGGGGAGGAAAAAGATTCAGATCCAGCGA
ATCACCGACGAGCGGAACCGACAGGTGACTTTCACCAAGCGGAAGTTTGGCCTGATGAAGAAGGCGTATG
AGCTGAGCGTGCTATGTGACTGCGAGATCGCACTCATCATCTTCAACCACTCCAACAAGCTGTTCCAGTA
CGCCAGCACCGACATGGACAAGGTGCTGCTCAAGTACACGGAGTACAATGAGCCACACGAGAGCCGCACC
AACGCCGACATCATCGAGACCCTGAGGAAGAAGGGCTTCAATGGCTGCGACAGCCCCGAGCCCGACGGGG
AGGACTCGCTGGAACAGAGCCCCCTGCTGGAGGACAAGTACCGACGCGCCAGCGAGGAGCTCGACGGGCT
```

Figure 20 (Continued)

```
CTTCCGGCGCTATGGGTCAACTGTCCCGGCCCCCAACTTTGCCATGCCTGTCACGGTGCCCGTGTCCAAT
CAGAGCTCACTGCAGTTCAGCAATCCCAGCGGCTCCCTGGTCACCCCTTCCCTGGTGACATCATCCCTCA
CGGACCCGCGGCTCCTGTCCCCCAGCAGCCAGCACTACAGAGGAACAGTGTGTCTCCTGGCCTGCCCCA
GCGGCCAGCTAGTGCGGGGGCCATGCTGGGGGGTGACCTGAACAGTGCTAACGGAGCCTGCCCCAGCCCT
GTTGGGAATGGCTACGTCAGTGCTCGGGCTTCCCCTGGCCTCCTCCCTGTGGCCAATGGCAACAGCCTAA
ACAAGGTCATCCCTGCCAAGTCTCCGCCCCCACCTACCCACAGCACCCAGCTTGGAGCCCCCAGCCGCAA
GCCCGACCTGCGAGTCATCACTTCCCAGGCAGGAAAGGGGTTAATGCATCACTTGACTGAGGACCATTTA
GATCTGAACAATGCCCAGCGCCTTGGGGTCTCCCAGTCTACTCATTCGCTCACCACCCCAGTGGTTTCTG
TGGCAACGCCGAGTTTACTCAGCCAGGGCCTCCCCTTCTCTTCCATGCCCACTGCCTACAACACAGATTA
CCAGTTGACCAGTGCAGAGCTCTCCTCCTTACCAGCCTTTAGTTCACCTGGGGGGCTGTCGCTAGGCAAT
GTCACTGCCTGGCAACAGCCACAGCAGCCCAGCAGCCGCAGCAGCCACAGCCTCCACAGCAGCAGCCAC
CGCAGCCACAGCAGCCACAGCCACAGCAGCCTCAGCAGCCGCAACAGCCACCTCAGCAACAGTCCCACCT
GGTCCCTGTATCTCTCAGCAACCTCATCCCGGGCAGCCCCTGCCCCACGTGGGTGCTGCCCTCACAGTC
ACCACCCACCCCCACATCAGCATCAAGTCAGAACCGGTGTCCCCAAGCCGTGAGCGCAGCCCTGCGCCTC
CCCCTCCAGCTGTGTTCCCAGCTGCCCGCCCTGAGCCTGGCGATGGTCTCAGCAGCCCAGCCGGGGATC
CTATGAGACGGGAGACCGGGATGACGGACGGGGGACTTCGGGCCCACACTGGGCCTGCTGCGCCCAGCC
CCAGAGCCTGAGGCTGAGGGCTCAGCTGTGAAGAGGATGCGGCTTGATACCTGGACATTAAAGTGACGAT
TCCCACTCCCCTCCTCTCAGCCTCCCTGATGAAGAGTTGACAATCTCACCGCCCGCCCTTCCCTGCCCCG
GGCTCCTCCCGCTCGACCCCCACTTCCTTTCTTGTGCTTCGTGTCCTGTTGACGGTTACATTTGTGTATA
ATTATTATATTATTATTATTATTATATTTTTTTAATTTGGATTCTCGCTTTGGAGAGGGGATGCT
CTCATCCCCTCTTTCTGTACCCCCCACCATTTTCACTGGCTGGGGGGCTCTCTTTTTCGCGGGAAGGGGG
GACACTTTGCACGTTGTACACATATGCTGCAGGAAGGGGGTGGGGGGCCCAATAAGGCCTTTGGGAAAGG
ACAGGTGCCGAGCCCTGCATGTGGAGCCCTCCCACCCCACCCCCAGATAGAGGGAAATAACCAAAAAACT
ACCAAACAACAGAAACCCACACTCTAGACTGAAACCCCAAAGTGGGCTTGATGGGTGGGTTTGTGTTTCA
AGGGGAAAGTGAGGCAGAGGTTCTGAAAAGGGTCTCTGTTTTTGTGTTCATGTAGCCATAGGCACATGGA
GCAGAATACTTAAGCCTGGCCCCCAAATGCCCCTGCACACACACGTGCCACACCTGCGCTGATTCTTGTG
TGTGCTGCACCCCCAAGGTGTGTGGGTGCTGGCTGAGCTTTGGGCCGGGAAGGCAGCCTGGGAATCTGAG
GCTGGAGACAGGGGTTTGAGGTGGGGCCTCTCTGGAAGCACATTTGGAGGGAAAGACAAGAGAGCCATG
AGGAGAGGGCTGAGGAGGGCAGAAGGGCTAGGCAGGGGCAAATTGAGCCCCTCCCTTCCCCAGTTTTTC
TCTAAGATATACAGTGCAATAGCTCCCCACCCCTCAGTTGACGCCAGCCCTGTAAAGCTGGCCACAGTGT
GCAGGGAGAATGGGGAGAGGGTCTTCAGTGAGGTGGCTGGGGCGAGAGTCGGCCTGGACTTCCCTGGGGT
GCTCCAGGCCAGAGCTCTTTCATTGGGGCGAGTGTGGTGAGGGGACGTCCTTGGTCTTGCACGCACACTA
CCTGGGGGAGTCAACACTGGGATGGTCTGTGGGGTGGGAGGGCCTACGGATGGGTCCGTAGAGGTCCCAC
CTCCCTCATTCCTCCTTGGCCCCTCTCCCTAGCTTCTCCTGTTAGCTCCTTCTGCTCCTGACCCCACCTC
CTTGCTCTTGGCGCCCCTATTGTCTCTGGCTACCTCCTTGTCCCACCACCTCCAGGCTGCATCCCACCTT
CCCTCTTGGCTACTGTAATTGTAAATAGCGACCTTTGGAAAACGTTAGCGGTGTAACAGTCCAGGAAACT
GTTTTTTTTGTTGTTGTTGTATTGATATGAAATGAGATTCTATTTTTGTCAAAGTATATTGTAATAATA
ATGACTCAAACGGCCCGTACTGTACAGACGAGATTCTTCTGCTGTTGTTCTTGCTCCCCTCCCCTCCTCT
GAGTCCGCCCCTCCCTGCTGCCTCCTCAGTGGGGCAGTGGGCAAGGGCCCAGGGGCAGCCGAAGCACGG
GGTCCTGAGACCTCAGGCAGGATTGGAGATCAAACCAGAGGGGGCAGGCCCCAGCCTGCTCTCTAGGAT
CACCCCCCGCCCTAAGGGGCCTGGCCTGGGGTGACGTGGCCAGGCAGACTGTCTGCCCCACTCCTTCACA
CAAGCCCAGCTCCTCTGCCCAAGGGGTGCGGCGCCCCTTGGGGTTTCCTCCCAGTTGGAGAGTAGAGTT
```

Figure 20 (Continued)

```
AAGACAAGGCCCAGTTTTGTGTTAGTCGACCGTCTTTGCCCACCTCTATGACCCAGCCTCTTGCAGTATT
CCCATACTTGATGCAGGGAAGGAACCAGAAGCAGAGGGGCCTCTACGCAGGTACACACGTGTACCTGAGT
GTGTTCATGAGGGCATCTGGTGTTTATGTGTCTGAGTGTAGCTTTGTATTTATGTGTGTGTGTGTGTGTA
TGTCTGATTGCACGGGTGTACTTTTGTATTTATGTGTGTGTGTGGTTGCACGGGTGTGCCTCTGTGTGTC
TCTGACCCTGGCTGGGTGTGTGTGCAAATCTGTGTGACTGGAGCTCTAGGGGCATCTCTGTGTCTGAGTG
TGCCTGGTGTGTGTTTACAAAGGGAGAGTTGGCTGCTCCAGCTCCACAGCCCTGGGACCCCAACTCCTGT
CTTCCCTGCTCCTTTCCCTGTGTTCACCCTCAGCTCTGACACATTGAACTGCAGTTGGGGGGATTGGCAG
TTAGCCCTCTGTGCTTCTCCCTGCAGCCCTACCTCTGCCAAGGTCTCTCCCTCCAGGGACCTCTGCTTCC
ACCCACATATGTCCACTTAGTCACCCACACTTGACACAGTTCCTGGAGTACCCTCTTCCCCAACCCCAG
ACCTGCTTTCAGAGCAAAACTCAAGTCCCTCTTCCTCCGTGAAGCTTCTCCCTCAGCTGAGCAGTGATCA
CTTACTCACTCTTAACCCCAATCCGCTGACTGGGTGGGGACAGCACGTCCAGCCTTCCCACCTCTCCTGC
AGGCTTCTAGACGGAGTTTCAAAAACTGATGAGCCTCGATCCAGGGCTTGAAAGAAGCCAGGGTGTAATC
TTGTTCATGCATGCGTCCCCAGAGCCTCGCCCAGTGCCTGGCACATAGTAGGCACTCAATAAATGCTGAA
TGGGTGAATAGTTGAATGATAGGTGCTCAATAAATGAATGAATGGCCTTCCCTTCTCAGGCTATTCCCAA
CATTAGTCTGCCCACCTTTCTAGGCTGGGCTTGGCCACCATTAAACACGGGGTGGGGGTGAGGGCCCCTG
CAATTCACGGTGCAATATTCACCAGTTTTGCCCTCTGCCTCATAAAGGCAAACCTGGCTTTTGATTACCA
TGTGTGGATGTTTCAGTGTCCTTTCTTCTCTGTCCCTGGGGATGGGGTGGTCTGTGAATATGTGACATTT
CTGCAGTTCAGTATCCGAAGGTTTCTCTTGGGGGTAGGGGCTCCTGGGCGGCCAGATGAATGGGTCCCTG
GGAACCCAGACCTCAGATGAGGACTTAATGTCTTCTTCCTCTCAAGCCAAATTCGCCTCCACCCACTCCC
TCTGAAGAACTGGGCATTTGCCAAAGTAACCACTGGAGTCATCTAATGGCCCTCCCCCTCCCCAGGTTTC
CCACAGCTTTCAGGGACAGTGGGCAAGAGGACACCCCCCCCACCACCTCAGTGGAACACACCATTCTCC
CCCCCTCAACAGCACACTCAGTGCAGCAAGACTGACCCCTGACCCCCTCCCAGCCCTCCCTACCTTGGAC
AGGAAGGAAGTAATGCACCTTCTCTTGCTGATTATTTATTTGTTTGGAGAGACAGAAATGTAAAAGTGTA
TCTAGAAATATCTATATCTCTATATATTTTTAACTGACTCTTTGGAATCCCCTGGGGTGGGGTGAGGGGT
AAGTTTAGGCTTTCGCGGAGGGGAGGAGACATGGAGCCTGGGAACTCCTTGTTCTCCCCTCTGCTGCCTC
TCCCCACCCCTTAAAGCAGTTGGTAGAAGGAATGGTATTTGTATGGGGGAGGGAGGCTGGAATGGAGAA
TCTGGATTCTCTCCTCTTCCCCATTCTCCAGAGGGAGGGAGGTGGTGAGGAAGAGGAAGGGAGGGGCAGG
ATGGGCCATGGAGGTGCCCCACCCCCACACCTGACAATCACCCACACTCCTGGGGCTCTTCCTGGGTCCT
GGGGCAGGGCGAGTCCAAGTGTGAGGCTGTTGATTTGTTTTCAATATTTCTTTTCGTGCTGTATGGTGAT
GCTTTCTTAGTATTCTACACAATAAGAAAAGACAAAGTCCTCGAGATTCTTATGAGTTTTGTTTGAAAAC
TCTTTCACTATATTTGTTGTAAAGAGGTTTACTATTAAAAGAAAAAGAATACACGTTTCTGATAAAAAAA
AAAAAAAA

>gi|33989660|gb|BC056415.1| Homo sapiens RNA polymerase II associated protein 3,
mRNA (cDNA clone MGC:64954 IMAGE:5218249), complete cds
CGGGGTGGCAGTGCGGCGGGTTACGGCCTGGTCAGACCATAATGACTTCAGCAAATAAAGCAATCGAATT
ACAACTACAAGTGAAACAAAATGCAGAAGAATTACAAGACTTTATGCGGGATTTAGAAAACTGGGAAAAA
GACATTAAACAAAAGGATATGGAACTAAGAAGACAGAATGGTGTTCCTGAAGAGAATTTACCTCCTATTC
GAAATGGGAATTTTAGGAAAAAGAAGAAAGGCAAAGCTAAAGAGTCTTCCAAAAAAACCAGAGAGGAAAA
CACAAAAAACAGGATAAAATCTTATGATTATGAGGCATGGGCAAAACTTGATGTGGACCGTATCCTTGAT
GAGCTTGACAAAGACGATAGTACCCATGAGTCTCTGTCTCAAGAATCAGAGTCGGAAGAAGATGGGATTC
ATGTAGATTCACAAAAGGCTCTTGTTTTAAAAGAAAAGGGCAATAAATACTTCAAACAAGGAAAATATGA
```

Figure 20 (Continued)

```
TGAAGCAATTGACTGCTACACAAAAGGCATGGATGCCGATCCATATAATCCCGTGTTGCCAACGAACAGA
GCGTCAGCATATTTTAGACTGAAAAAATTTGCTGTTGCTGAGTCTGATTGTAATTTAGCAGTTGCCTTGA
ATAGAAGTTATACAAAGGCTTATTCCAGACGAGGTGCTGCTCGATTTGCTTTGCAAAAATTAGAAGAGGC
CAAAAAAGATTATGAAAGAGTATTAGAACTAGAACCAAATAACTTTGAAGCAACAAATGAACTCAGGAAA
ATCAGTCAGGCTTTAGCATCCAAAGAAAACTCATATCCAAAGGAAGCTGACATAGTGATTAAGTCAACAG
AAGGAGAGCGAAAGCAAATTGAAGCACAACAGAATAAGCAGCAGGCCATTTCAGAGAAAGATCGGGGGAA
TGGATTTTTCAAAGAGGGGAAATATGAAAGAGCAATTGAATGCTATACTCGAGGGATAGCAGCAGATGGT
GCTAATGCCCTTCTTCCAGCTAACAGAGCTATGGCCTATCTGAAGATTCAGAAATATGAAGAAGCTGAAA
AAGACTGCACACAAGCCATTTTATTAGATGGCTCATATTCTAAAGCTTTTGCCAGAAGAGGAACTGCAAG
AACATTTTTGGGAAAGCTAAATGAGGCAAAACAAGATTTTGAAACTGTTTTACTTCTGGAACCTGGAAAT
AAGCAAGCAGTAACTGAACTCTCCAAAATTAAAAAGAAACCACTCAAGAAGGTTATTATTGAAGAAACTG
GTAATTTGATACAGACTATTGATGTGCCAGATAGCACTACTGCTGCTGCTCCAGAGAATAATCCTATTAA
TCTAGCAAATGTAATAGCAGCCACAGGCACCACAAGTAAGAAGAATTCAAGCCAAGATGACCTTTTTCCC
ACAAGTGATACTCCAAGAGCAAAAGTATTGAAAATAGAAGAAGTCAGTGATACTTCATCCCTGCAACCTC
AAGCCAGTTTGAAGCAGGATGTATGTCAGTCTTACAGCGAGAAAATGCCCATAGAGATAGAACAAAAACC
TGCTCAGTTTGCCACAACTGTTCTTCCTCCAATTCCTGCAAACTCGTTCCAGCTCGAATCTGATTTCAGA
CAATTGAAAAGTTCTCCAGATATGTTGTATCAGTATTTAAAGCAAATTGAACCATCTTTGTATCCTAAGT
TGTTTCAGAAAAATCTGGATCCAGATGTATTCAACCAGATCGTTAAAATTCTGCATGACTTTTACATTGA
GAAAGAAAAGCCATTACTCATCTTTGAAATCTTACAAAGACTTTCTGAACTAAAAAGGTTTGATATGGCA
GTGATGTTTATGTCAGAAACAGAGAAAAAGATTGCACGTGCATTATTTAATCACATAGACAAGTCAGGAT
TGAAGGATAGTTCTGTCGAAGAACTCAAGAAAAGATACGGTGGTTGATTTCCATTTTTGCTGAAATAATT
GTTTTTGACTTTCATATGTAAATTTTTTCTACTGAAAGTGTTTTGCTTTTTAAGAAAATGAAATTATATA
GCAGGAAAGGACTATCTTTGAACATAAGTTAATTAACTATAAGGTGAATTGTGATTTAACTAGTGAGAAT
TGTATTCAAGTGAACTCTGTTTTTCTGAAAATAAAAATATAAACAATGAAAAAAAAAAAAAAAAAAAAAA
AAAAAAAAAA

>gi|38173801|gb|BC060833.1| Homo sapiens proline rich Gla (G-carboxyglutamic
acid) 1, mRNA (cDNA clone MGC:71712 IMAGE:30348133), complete cds
TGGAGCGCGCAGGCGCGACGTGCGGCTCGCAGAACGGCGAGTAGCGGAGCGGGACCCGCTGGAATCATCA
TCCAGGGACGTGCCAGAAACCACAAGAAAACATGGGGAGGGTTTTCCTCACGGGAGAAAAAGCCAATTCC
ATATTAAAACGCTACCCAAGAGCTAATGGGTTTTTTGAAGAAATAAGACAGGGCAACATTGAGCGTGAGT
GCAAAGAAGAATTCTGTACATTTGAAGAAGCAAGAGAAGCTTTTGAAAATAATGAAAAAACTAAGGAGTT
TTGGAGCACCTACACAAAAGCGCAACAAGGGGAGAGTAACCGAGGAAGTGACTGGTTTCAGTTTTACCTT
ACCTTTCCGTTAATCTTTGGCCTCTTCATTATCCTCCTTGTCATTTTCCTAATCTGGAGATGCTTCCTAA
GAAACAAAACTCGTAGACAGACAGTGACTGAAGGCCACATTCCTTTCCCTCAGCACCTTAATATTATCAC
CCCACCCCCCCACCAGATGAAGTGTTTGACAGCAGTGGATTGTCTCCAGGCTTTCTGGGATATGTAGTT
GGGCGCTCAGATTCCGTCTCTACTCGCCTGTCCAATTGTGATCCCCGCCAACCTATGAGGAAGCCACTG
GCCAAGTGAACCTGCAGAGGAGTGAAACAGAACCTCATTTAGACCCACCCCCAGAGTATGAGGACATAGT
CAACTCCAACTCAGCCAGTGCCATTCCTATGGTGCCTGTGGTCACCACCATCAAATGAAGCTGCAAACTT
CTTTTTACTCTAATCATTTTTAAAATACTAATGGAAGAACTTTCTAGCACTTTACCACTACATAAATGTT
CATTGACTTATTTTATTGGACTCTTACCGCATACCACTTCACACTTGTTTTATTTTCTTTAGTTTTGTTT
CTTGTTATAGAATCATTATCCATGCTCATTTTTGCTAGGGGAAATATATGAAGAGGGAAAACATACTAAT
```

Figure 20 (Continued)

```
GGGGGTCTTTCTGTGATGTGATGAGACATACATGTAAGTGTATATATGTGTGTATAGGCATATATACGTG
TGTATGCATCAACACAGTATATGTAAAACTGTCTTAAAAATCCATTAACTTCTACCTAAATCACCTGGAA
GGAGAGCATTGCTCACCAAAATTGCAAAACAAGGGTATCAAGAATTTGTGTAATAGCCAGTGACATGCTG
TAGATTTTTGCAAACTGGATGTACTTAGCATGTTTTCTAATTCTGACTGGCTTTTGTTAACTTGATAATT
CTTCATCTACCTTAAAAAGAAAAAAATTACACATAGTCATTCTTGATGTTATAAATAGAGAAAAAGTGTG
TGTGAGCAATAATGCATAAGCTACTGATAACTTGCTTACAGCAGATAGCAATAAGGTATTTGGTGGCATT
CGGCTTGTTTTGTAATAGGGATTTTTTTTTGGTTGACCACTCCCCCACACTTCCAAAATTAAACAGTGT
TTTCTTAGCATCTTGAATATCTCCTGCGGTGTATATTAACATCTTGATGAGACAGATTTCCAGGCAACAA
AATAATTTCTAAAATGGATATATGTGTGGATTAATGACAGGCAGTAAATACCCATTACTCCTTTACTCAT
AGCTGGTAAAATTATTCCCACTGTTTTATTGCCTTTTACTGTACGTTCTACACTCTGTCCTACTCCCACA
GAATTTTCAAGCCCTTAAGAGTTTAGTTAAAATAAAATTTTTGAAATTATTGTCTTAATATTTTTATATA
GGCTGATGTCTTTGCCTCAAGATTGTTAGGAGGTAATTTTCCATTGAATTATCAACTGTGATTTTTATAG
TGCCCTCCAAGTGGTAGAAGAAGATTGCAAAGTCCATGTTATGCTAGGTGCACAATAAATCTAGTAATAG
CCCCACACAGATCTCATCATTGTTGCTACTTCCTTTTGTATTTTCATCAGGTATTTTTTTAACTGTAGGG
TTTTTACTTTTTTCTTGGAGCAGAGAGAACAGGCTGTAAATGGGTTGCCAACATAAGCTGGCTGAGAAAT
AAAAGAAAACAAGACAGTTGTTCATAAAGTTTCATTTTGTATGCACTGATGGCAAATTCATTAGGTCAGT
TAAGGGAAATATTTGTACCACTTCCAAACTTTTCAGCGTTGGATAAAATGATTGATGAGGCAGGCAGAAG
GAATGTAGGTTTCAGGTGTGTCATTTCCTGCTGCTTCCAGCTCCATCCCTACAGACTCCTCCCCGAGTCC
TGCCCTGGAACCAAAGGAAGGAGGAACACTGAGGGGAATCCTGAAGTAGGAGTCAGATGACCTGAACTCA
GATCTCCCTCTATCACATGCTTGCCACCACTGTACCTTGAGCAAGAATCATATCTGACCCTCAACCTCCT
CAACTCTAAAATGGGGATAACATCATTTGTCCTGCACTTCTCTAAGGGCTTTACAAGGATCAAATAAGAT
GGTGTGTATGTAAGAAATTTGTAAAATGTGAAGAGCTATCTACACTAAGTTCGTAATGTTATTATTATTG
TGCTTCATGGAGAATTTTCCCCTCTGTTTTCCTAAATTGTATGAGAGCTTTCACACAGTGAGAAATAGAG
CAGGCTGCCCCATAAATGGGTAACATATTCCTAATCTGAGTGTGTGGGCTGTTAGAGAACCCCTGCCATG
CTCTGGTCTGTTCTGAAACTGTGCCAACTGAAAGATGATAGTCCACACAGCACAAACAGGTTTAAGCAAA
TGATAGAAAGGGAAGTAAGGCGTGTGTGCTAGTTAATAGGTTTAGTAGCTTTTATGGACTAAAAATGATT
GATTGTATCTTGACCCTGGTCTCAGAAATGACATTTTTACTTTTGCCATGAGTACACATCAGATATCTTT
GGCTTCTATTTAAAGCTAAAGGTAGAAGTGTTTGATCCAGTGAACTGTGTATGTATGTGTGGGTTTTTT
TTCTTTATTTTTAAATGAAAATTAAGCACACCTTTTGTGTGGACATGTTTTTGTCTTTAATGTCAGGCTTT
AGATTAGACCAGCAGTTTTCAAAGTATGGCCAATGGACCCCTGGGTTCCTTGAGAGCCTTTCAGGGGGGA
CTATGAGATCAAAATATTTTTATTATAATGTGAAGACATTGTCTTTTCACTCTATCTCAAAAAAAGTGTT
GCAAATGTAAAACATTGCCATCTTCTCACAAATCTCTTTTTTTGTTTTTGAAAATATGGCCATTTTTCAT
AAAATGTTATTTGTGTTAGCATGTAATGGGTTACTATGTTTAAATAAGTTAATACTTTAAAAATTTTCA
GGTTTTTTTAGTATGGTGAATATTGATAGATATAAACCTCATGAACAAAAGTACTTTGGCATCCAGATTC
TCAATAAATGTTAAGAGCGTAAGTGTAAGGGGGTCCAGAGACCAAAAGTTTTAGAGCTACAGGATTAGAC
ATAGGAGCAGGATATTCTGTTAGTGTGATTTCTTGCAACTTTATTTTACATTTTAAACTGCTGATATTGG
ATATAATGCTGCTTTTTAGAGACACCTAAATTGCAGTATCAGAATGAATGTTGATGTTTGAAGCCAAAAA
GCCAAATGCTTAAACTGATCAATGACTGTAGCTTTTTAGACTGTTGGTCAAAGAACATTCTACTTCACAG
TAATAGCTCTATCAGCCACAGATCTCATGGTGGCTGTTGCATGATAATGATAGGATAAACAAAATACCAC
TGTCTTCAAGAAACATTATCTTAGGTTTGTTTGTTTGGTTTGAGTTTGATTTGGCTTTTATATTTTTTAA
AATCCCTTTTGCTACCCCATCTGGTTTTATAAACTGAGTTTCTTAGCATTCGTTAAAATTAAGGGGTTTG
TTTGGAATAATATATATTTTTTATGCTTTTGTCTTTCTTACCTGATTGATATTACATTCACCTTTGATTG
```

Figure 20 (Continued)

```
TTTTTTAAAAGTTTATTTTTACAGAATATATTTAGTACCTTTCTTAAGGAGTAACTGAATTGAATCAACC
AGTTTGCATTTAAATAAAAGAACAGGCTCAGTGGTCTTCCTGTAGAATGGTTTACATGCCTGCATGTGCA
GTAGTTGTGTCTGGAATCCTAGAATTGGCACTTTCTGCCTCCTTGCTCTAAATGTCACAAAAAATTATAC
TTCCTTAAAGTAAATGTAATGATTTCTTCTTTTCCTATTGACCAGTACAGATAGATATGTTGTGTTTGCT
TCATTTTTAATGATGACTTCAAGATTGATGATGTGATCCAATAACTGTGGAGGTAGCTTTAACTTGGTTC
TGTGTAAATAGTATGTATTTTATTATAATATTTCTCATTTTAAGATGCTTGGTTTACATTAAATTATGGT
ATTTAACTATTTTTATGTTTATACTAGGTAGGGTCTTTCTTATGTTTCTGTGTTTTTGGTATGCTAAATA
AAGCTATTTTTAAACCCAAAAAAAAAAAAAAAA

>gi|39963544|gb|BC064367.1| Homo sapiens ankyrin repeat and sterile alpha motif
domain containing 6, mRNA (cDNA clone MGC:70366 IMAGE:5562895), complete cds
GGTCAATGGGGACGGGGCGACGCCACTGATGCTAGCAGCTGTTACGGGGCAGCTGGCTCTGGTGCAGCTG
CTGGTGGAGAGGCACGCGGATGTTGACAAGCAGGACAGCGTGCATGGCTGGACGGCCCTCATGCAGGCAA
CCTACCATGGGAATAAGGAAATTGTGAAATATCTGCTAAACCAAGGGGCCGATGTCACTCTTCGTGCAAA
AAATGGATACACGGCCTTTGACCTGGTGATGCTGCTGAATGATCCCGACACGGAACTTGTTCGACTGCTG
GCATCTGTCTGCATGCAGGTGAATAAAGACAAAGGCCGGCCGAGCCACCAGCCTCCCCTGCCCCACTCGA
AGGTCCGACAGCCCTGGAGCATCCCAGTGCTGCCCGATGACAAGGGTGGACTGAAGTCCTGGTGGAACCG
AATGTCCAATCGGTTCCGAAAGCTCAAACTGATGCAGACGCTGCCCCGTGGGCTGTCCAGCAACCAGCCT
TTGCCTTTCTCTGACGAGCCTGAGCCAGCTCTGGACTCCACAATGAGGGCTGCCCCCAGGACAAGACAA
GCCGCTCTGCACTCCCTGATGCGGCCCCTGTGACCAAAGACAATGGTCCTGGGAGCACAAGAGGAGAAAA
GGAAGACACGTTATTGACAACCATGCTTCGAAACGGAGCTCCCCTCACCAGACTCCCGAGTGACAAGCTG
AAAGCAGTCATCCCCCCATTCCTACCCCCTTCCAGTTTTGAGCTGTGGAGCTCTGATCGGTCCCGGACGC
GTCACAACGGGAAGGCAGACCCCATGAAGACTGCGCTGCCCCAGAGAGCCAGCAGGGGCCACCCCGTGGG
CGGCGGGGGCACAGACACTACACCCGTCAGGCCTGTTAAATTTCCAAGCCTCCCCAGAAGCCCAGCCTCT
TCTGCCAATTCTGGAAACTTCAACCACTCGCCTCATTCATCGGGCGGCTCCAGTGGGATAGGTGTGAGCC
GGCACGGTGGGGAGCTGCTTAACCGCTCAGGTGGCAGCATAGACAATGTCTTGTCCCAAATCGCTGCCCA
GAGGAAAAAAGCAGCCGGATTATTGGAGCAGAAACCCAGCCATCGGTCAAGCCCTGTGGGGCCAGCACCG
GGGTCCAGCCCGTCTGAGCTTCCAGCCTCCCCTGCAGGTGGCAGCGCTCCTGTTGGCAAGAAATTGGAGA
CCAGCAAAAGGCCTCCATCTGGAACTTCCACTACCTCCAAGAGCACCTCTCCAACCCTCACGCCCTCCCC
CTCACCCAAAGGGCACACTGCAGAGTCCTCAGTGTCTTCCTCGTCATCCCATCGGCAGTCCAAGAGCAGT
GGGGGCTCCAGCAGTGGCACCATCACAGATGAGGATGAACTGACTGGAATCCTTAAGAAATTATCACTTG
AGAAATATCAGCCCATTTTTGAGGAACAAGAGGTGGACATGGAAGCGTTCCTCACACTGACTGACGGTGA
CTTGAAGGAGCTGGGAATTAAGACAGATGGGTCCAGGCAGCAGATTCTGGCAGCGATTTCTGAACTGAAC
GCAGGCAAGGGACGCGAGAGACAAATTTTACAGGAAACCATTCACAACTTTCACTCTTCCTTTGAGAGCA
GTGCCAGCAACACCAGGGCCCCTGGCAACAGCCCCTGTGCGTGATCCTCCTTCCCGCAGCCACCAGCGTG
AGCTCTCTGAATCCCGGGACCCCTTCACGTGGCCACAGCCCCAGCCCTGCCCCCGTCACACTGCTGTGCC
TTAGTCATGTTGTTCCCTTTGCTCGGGATGCCCACTTCACGTCGACGGCATTCATTGGTAGTACTTCTTG
CTGCAACAAACTTCAACACACAGAGACAGATTCCCATGTAACAGTCCAGTGGGGTGCTTCTGCTTGGCA
CGTTGGTTCACACAGTGATGCAGGGACTCAGCTCCTTTCATCCTGTGCTCTGCCCTCCCGGGAGCCTCA
GAGTTTGCTTCTGGCTGGCGGCAAGGGAAAGGGACGATGGAGAAGGCACGGCTGCTTCTTACCTGCCTTG
CTCTTAACTGACACACATCACTCCTGCTCACGTCCTCTTGGCCACTGGTAGTCATGTGGCCCCACCTGGA
TGCAGAGGAGGCCAGGATGTGCAGTCTCCACATAGTGGCTTCCCAGCAACAACTTTTGACTTAGATGGGG
```

Figure 20 (Continued)

```
GGTATGTATTATGGTGAGAGGTTAGCCTTCCTGGCACATCTTCCCTTAAAACTTCTAACTTGCCCCTCCT
AGTCCAAGTCACCTCTCAGATGAAGTCTTTTTTGACCCCCTTTCAGCCACTGGGTCCCTTAGTGCTGTGT
ATGTGACTGCTGTAGCATTCCACTGCACCTGCTGCATACAGCTTACATTGGAGATGTGTATGTCAAACGC
ATTTTTCTTTATTGCAAAGAGAGTCTATTATAGAAGGAAAGAAGTGGAGGCCTGCTGTGTGGATCCCTTC
TTCTTCCTAGCTTTCAGTTTCCTTATCTGCAAAGTGGAAGGTCAGACCAGATGATGCTCTGGTACTCCAC
AGTGCTCACCTGTATCACTGCAGGGCTTTCTGCACTGAAAGTGGAAGCAGAAGGCTAATGGGTCACATTG
TGTAAAGGTCTCTGGTGCTCAAAGTTTCTAGGCAAAGAAGTGAAAATTTGGAATTTTGTCTACATCCTAT
TAATGCTGTGTTCCTCAAAAGGGAATTGGCTTGTGTAGTTTCCTACCATATCATATTTTATTAAATTAGA
GGGGCCCTGACTTTTAAAACCCAAAAAAAAAAAAAAAAAAAAAAAAAAAAAAAAAAAAAAAAAAAAAAAA

>gi|323098327|ref|NM_000585.4| Homo sapiens interleukin 15 (IL15), transcript
variant 3, mRNA
GTTGGGACTCCGGGTGGCAGGCGCCCGGGGGAATCCCAGCTGACTCGCTCACTGCCTTCGAAGTCCGGCG
CCCCCCGGGAGGGAACTGGGTGGCCGCACCCTCCCGGCTGCGGTGGCTGTCGCCCCCCACCCTGCAGCCA
GGACTCGATGGAGAATCCATTCCAATATATGGCCATGTGGCTCTTTGGAGCAATGTTCCATCATGTTCCA
TGCTGCTGACGTCACATGGAGCACAGAAATCAATGTTAGCAGATAGCCAGCCCATACAAGATCGTATTGT
ATTGTAGGAGGCATTGTGGATGGATGGCTGCTGGAAACCCCTTGCCATAGCCAGCTCTTCTTCAATACTT
AAGGATTTACCGTGGCTTTGAGTAATGAGAATTTCGAAACCACATTTGAGAAGTATTTCCATCCAGTGCT
ACTTGTGTTTACTTCTAAACAGTCATTTTCTAACTGAAGCTGGCATTCATGTCTTCATTTTGGGCTGTTT
CAGTGCAGGGCTTCCTAAAACAGAAGCCAACTGGGTGAATGTAATAAGTGATTTGAAAAAAATTGAAGAT
CTTATTCAATCTATGCATATTGATGCTACTTTATATACGGAAAGTGATGTTCACCCCAGTTGCAAAGTAA
CAGCAATGAAGTGCTTTCTCTTGGAGTTACAAGTTATTTCACTTGAGTCCGGAGATGCAAGTATTCATGA
TACAGTAGAAAATCTGATCATCCTAGCAAACAACAGTTTGTCTTCTAATGGGAATGTAACAGAATCTGGA
TGCAAAGAATGTGAGGAACTGGAGGAAAAAAATATTAAAGAATTTTTGCAGAGTTTTGTACATATTGTCC
AAATGTTCATCAACACTTCTTGATTGCAATTGATTCTTTTTAAAGTGTTTCTGTTATTAACAAACATCAC
TCTGCTGCTTAGACATAACAAAACACTCGGCATTTCAAATGTGCTGTCAAAACAAGTTTTTCTGTCAAGA
AGATGATCAGACCTTGGATCAGATGAACTCTTAGAAATGAAGGCAGAAAAATGTCATTGAGTAATATAGT
GACTATGAACTTCTCTCAGACTTACTTTACTCATTTTTTTAATTTATTATTGAAATTGTACATATTTGTG
GAATAATGTAAAATGTTGAATAAAAATATGTACAAGTGTTGTTTTTTAAGTTGCACTGATATTTTACCTC
TTATTGCAAAATAGCATTTGTTTAAGGGTGATAGTCAAATTATGTATTGGTGGGGCTGGGTACCAATGCT
GCAGGTCAACAGCTATGCTGGTAGGCTCCTGCCAGTGTGGAACCACTGACTACTGGCTCTCATTGACTTC
CTTACTAAGCATAGCAAACAGAGGAAGAATTTGTTATCAGTAAGAAAAAGAAGAACTATATGTGAATCCT
CTTCTTTATACTGTAATTTAGTTATTGATGTATAAAGCAACTGTTATGAAATAAAGAAATTGCAATAACT
GGCATATAATGTCCATCAGTAAATCTTGGTGGTGGTGGCAATAATAAACTTCTACTGATAGGTAGAATGG
TGTGCAAGCTTGTCCAATCACGGATTGCAGGCCACATGCGGCCCAGGACAACTTTGAATGTGGCCCAACA
CAAATTCATAAACTTTCATACATCTCGTTTTTAGCTCATCAGCTATCATTAGCGGTAGTGTATTTAAAGT
GTGGCCCAAGACAATTCTTCTTATTCCAATGTGGCCCAGGGAAATCAAAAGATTGGATGCCCCTGGTATA
GAAAACTAATAGTGACAGTGTTCATATTTCATGCTTTCCCAAATACAGGTATTTTATTTTCACATTCTTT
TTGCCATGTTTATATAATAATAAAGAAAAACCCTGTTGATTTGTTGGAGCCATTGTTATCTGACAGAAAA
TAATTGTTTATATTTTTTGCACTACACTGTCTAAAATTAGCAAGCTCTCTTCTAATGGAACTGTAAGAAA
GATGAAATATTTTTGTTTTATTATAAATTTATTTCACCTTAAAAAAAAAAAA
```

Figure 20 (Continued)

```
>gi|119220593|ref|NM_000875.3| Homo sapiens insulin-like growth factor 1 receptor
(IGF1R), mRNA
TTTTTTTTTTTTTTTTTGAGAAAGGGGAATTTCATCCCAAATAAAAGGAATGAAGTCTGGCTCCGGAGG
AGGGTCCCCGACCTCGCTGTGGGGGCTCCTGTTTCTCTCCGCCGCGCTCTCGCTCTGGCCGACGAGTGGA
GAAATCTGCGGGCCAGGCATCGACATCCGCAACGACTATCAGCAGCTGAAGCGCCTGGAGAACTGCACGG
TGATCGAGGGCTACCTCCACATCCTGCTCATCTCCAAGGCCGAGGACTACCGCAGCTACCGCTTCCCCAA
GCTCACGGTCATTACCGAGTACTTGCTGCTGTTCCGAGTGGCTGGCCTCGAGAGCCTCGGAGACCTCTTC
CCCAACCTCACGGTCATCCGCGGCTGGAAACTCTTCTACAACTACGCCCTGGTCATCTTCGAGATGACCA
ATCTCAAGGATATTGGGCTTTACAACCTGAGGAACATTACTCGGGGGCCATCAGGATTGAGAAAAATGC
TGACCTCTGTTACCTCTCCACTGTGGACTGGTCCCTGATCCTGGATGCGGTGTCCAATAACTACATTGTG
GGGAATAAGCCCCCAAAGGAATGTGGGGACCTGTGTCCAGGGACCATGGAGGAGAAGCCGATGTGTGAGA
AGACCACCATCAACAATGAGTACAACTACCGCTGCTGGACCACAAACCGCTGCCAGAAAATGTGCCCAAG
CACGTGTGGGAAGCGGGCGTGCACCGAGAACAATGAGTGCTGCCACCCCGAGTGCCTGGGCAGCTGCAGC
GCGCCTGACAACGACACGGCCTGTGTAGCTTGCCGCCACTACTACTATGCCGGTGTCTGTGTGCCTGCCT
GCCCGCCCAACACCTACAGGTTTGAGGGCTGGCGCTGTGTGGACCGTGACTTCTGCGCCAACATCCTCAG
CGCCGAGAGCAGCGACTCCGAGGGGTTTGTGATCCACGACGGCGAGTGCATGCAGGAGTGCCCCTCGGGC
TTCATCCGCAACGGCAGCCAGAGCATGTACTGCATCCCTTGTGAAGGTCCTTGCCCGAAGGTCTGTGAGG
AAGAAAAGAAAACAAAGACCATTGATTCTGTTACTTCTGCTCAGATGCTCCAAGGATGCACCATCTTCAA
GGGCAATTTGCTCATTAACATCCGACGGGGGAATAACATTGCTTCAGAGCTGGAGAACTTCATGGGGCTC
ATCGAGGTGGTGACGGGCTACGTGAAGATCCGCCATTCTCATGCCTTGGTCTCCTTGTCCTTCCTAAAAA
ACCTTCGCCTCATCCTAGGAGAGGAGCAGCTAGAAGGGAATTACTCCTTCTACGTCCTCGACAACCAGAA
CTTGCAGCAACTGTGGGACTGGGACCACCGCAACCTGACCATCAAAGCAGGGAAAATGTACTTTGCTTTC
AATCCCAAATTATGTGTTTCCGAAATTTACCGCATGGAGGAAGTGACGGGGACTAAAGGGCGCCAAAGCA
AAGGGGACATAAACACCAGGAACAACGGGGAGAGAGCCTCCTGTGAAAGTGACGTCCTGCATTTCACCTC
CACCACCACGTCGAAGAATCGCATCATCATAACCTGGCACCGGTACCGGCCCCCTGACTACAGGGATCTC
ATCAGCTTCACCGTTTACTACAAGGAAGCACCCTTTAAGAATGTCACAGAGTATGATGGGCAGGATGCCT
GCGGCTCCAACAGCTGGAACATGGTGGACGTGGACCTCCCGCCCAACAAGGACGTGGAGCCCGGCATCTT
ACTACATGGGCTGAAGCCCTGGACTCAGTACGCCGTTTACGTCAAGGCTGTGACCCTCACCATGGTGGAG
AACGACCATATCCGTGGGGCCAAGAGTGAGATCTTGTACATTCGCACCAATGCTTCAGTTCCTTCCATTC
CCTTGGACGTTCTTTCAGCATCGAACTCCTCTTCTCAGTTAATCGTGAAGTGGAACCCTCCCTCTCTGCC
CAACGGCAACCTGAGTTACTACATTGTGCGCTGGCAGCGGCAGCCTCAGGACGGCTACCTTTACCGGCAC
AATTACTGCTCCAAAGACAAAATCCCCATCAGGAAGTATGCCGACGGCACCATCGACATTGAGGAGGTCA
CAGAGAACCCCAAGACTGAGGTGTGTGGTGGGGAGAAAGGGCCTTGCTGCGCCTGCCCCAAAACTGAAGC
CGAGAAGCAGGCCGAGAAGGAGGAGGCTGAATACCGCAAAGTCTTTGAGAATTTCCTGCACAACTCCATC
TTCGTGCCCAGACCTGAAAGGAAGCGGAGAGATGTCATGCAAGTGGCCAACACCACCATGTCCAGCCGAA
GCAGGAACACCACGGCCGCAGACACCTACAACATCACCGACCCGGAAGAGCTGGAGACAGAGTACCCTTT
CTTTGAGAGCAGAGTGGATAACAAGGAGAGAACTGTCATTTCTAACCTTCGGCCTTTCACATTGTACCGC
ATCGATATCCACAGCTGCAACCACGAGGCTGAGAAGCTGGGCTGCAGCGCCTCCAACTTCGTCTTTGCAA
GGACTATGCCCGCAGAAGGAGCAGATGACATTCCTGGGCCAGTGACCTGGGAGCCAAGGCCTGAAAACTC
CATCTTTTTAAAGTGGCCGGAACCTGAGAATCCCAATGGATTGATTCTAATGTATGAAATAAAATACGGA
TCACAAGTTGAGGATCAGCGAGAATGTGTGTCCAGACAGGAATACAGGAAGTATGGAGGGGCCAAGCTAA
ACCGGCTAAACCCGGGGAACTACACAGCCCGGATTCAGGCCACATCTCTCTCTGGGAATGGGTCGTGGAC
```

Figure 20 (Continued)

```
AGATCCTGTGTTCTTCTATGTCCAGGCCAAAACAGGATATGAAAACTTCATCCATCTGATCATCGCTCTG
CCCGTCGCTGTCCTGTTGATCGTGGGAGGGTTGGTGATTATGCTGTACGTCTTCCATAGAAAGAGAAATA
ACAGCAGGCTGGGGAATGGAGTGCTGTATGCCTCTGTGAACCCGGAGTACTTCAGCGCTGCTGATGTGTA
CGTTCCTGATGAGTGGGAGGTGGCTCGGGAGAAGATCACCATGAGCCGGGAACTTGGGCAGGGGTCGTTT
GGGATGGTCTATGAAGGAGTTGCCAAGGGTGTGGTGAAAGATGAACCTGAAACCAGAGTGGCCATTAAAA
CAGTGAACGAGGCCGCAAGCATGCGTGAGAGGATTGAGTTTCTCAACGAAGCTTCTGTGATGAAGGAGTT
CAATTGTCACCATGTGGTGCGATTGCTGGGTGTGGTGTCCCAAGGCCAGCCAACACTGGTCATCATGGAA
CTGATGACACGGGGCGATCTCAAAAGTTATCTCCGGTCTCTGAGGCCAGAAATGGAGAATAATCCAGTCC
TAGCACCTCCAAGCCTGAGCAAGATGATTCAGATGGCCGGAGAGATTGCAGACGGCATGGCATACCTCAA
CGCCAATAAGTTCGTCCACAGAGACCTTGCTGCCCGGAATTGCATGGTAGCCGAAGATTTCACAGTCAAA
ATCGGAGATTTTGGTATGACGCGAGATATCTATGAGACAGACTATTACCGGAAAGGAGGGAAAGGGCTGC
TGCCCGTGCGCTGGATGTCTCCTGAGTCCCTCAAGGATGGAGTCTTCACCACTTACTGGACGTCTGGTC
CTTCGGGGTCGTCCTCTGGGAGATCGCCACACTGGCCGAGCAGCCCTACCAGGGCTTGTCCAACGAGCAA
GTCCTTCGCTTCGTCATGGAGGGCGGCCTTCTGGACAAGCCAGACAACTGTCCTGACATGCTGTTTGAAC
TGATGCGCATGTGCTGGCAGTATAACCCCAAGATGAGGCCTTCCTTCCTGGAGATCATCAGCAGCATCAA
AGAGGAGATGGAGCCTGGCTTCCGGGAGGTCTCCTTCTACTACAGCGAGGAGAACAAGCTGCCCGAGCCG
GAGGAGCTGGACCTGGAGCCAGAGAACATGGAGAGCGTCCCCCTGGACCCCTCGGCCTCCTCGTCCTCCC
TGCCACTGCCCGACAGACACTCAGGACACAAGGCCGAGAACGGCCCCGGCCCTGGGGTGCTGGTCCTCCG
CGCCAGCTTCGACGAGAGACAGCCTTACGCCCACATGAACGGGGGCCGCAAGAACGAGCGGGCCTTGCCG
CTGCCCCAGTCTTCGACCTGCTGATCCTTGGATCCTGAATCTGTGCAAACAGTAACGTGTGCGCACGCGC
AGCGGGGTGGGGGGGAGAGAGTTTTAACAATCCATTCACAAGCCTCCTGTACCTCAGTGGATCTTCA
GAACTGCCCTTGCTGCCCGCGGGAGACAGCTTCTCTGCAGTAAAACACATTTGGGATGTTCCTTTTTTCA
ATATGCAAGCAGCTTTTTATTCCCTGCCCAAACCCTTAACTGACATGGGCCTTTAAGAACCTTAATGACA
ACACTTAATAGCAACAGAGCACTTGAGAACCAGTCTCCTCACTCTGTCCCTGTCCTTCCCTGTTCTCCCT
TTCTCTCTCCTCTCTGCTTCATAACGGAAAAATAATTGCCACAAGTCCAGCTGGGAAGCCCTTTTTATCA
GTTTGAGGAAGTGGCTGTCCCTGTGGCCCCATCCAACCACTGTACACACCCGCCTGACACCGTGGGTCAT
TACAAAAAAACACGTGGAGATGGAAATTTTTACCTTTATCTTTCACCTTTCTAGGGACATGAAATTTACA
AAGGGCCATCGTTCATCCAAGGCTGTTACCATTTTAACGCTGCCTAATTTTGCCAAAATCCTGAACTTTC
TCCCTCATCGGCCCGGCGCTGATTCCTCGTGTCCGGAGGCATGGGTGAGCATGGCAGCTGGTTGCTCCAT
TTGAGAGACACGCTGGCGACACACTCCGTCCATCCGACTGCCCCTGCTGTGCTGCTCAAGGCCACAGGCA
CACAGGTCTCATTGCTTCTGACTAGATTATTATTTGGGGGAACTGGACACAATAGGTCTTTCTCTCAGTG
AAGGTGGGGAGAAGCTGAACCGGCTTCCCTGCCCTGCCTCCCCAGCCCCTGCCCAACCCCCAAGAATCT
GGTGGCCATGGGCCCCGAAGCAGCCTGGCGGACAGGCTTGGAGTCAAGGGGCCCCATGCCTGCTTCTCTC
CCAGCCCCAGCTCCCCCGCCCGCCCCCAAGGACACAGATGGGAAGGGGTTTCCAGGGACTCAGCCCCACT
GTTGATGCAGGTTTGCAAGGAAAGAAATTCAAACACCACAACAGCAGTAAGAAGAAAAGCAGTCAATGGA
TTCAAGCATTCTAAGCTTTGTTGACATTTTCTCTGTTCCTAGGACTTCTTCATGGGTCTTACAGTTCTAT
GTTAGACCATGAAACATTTGCATACACATCGTCTTTAATGTCACTTTTATAACTTTTTTACGGTTCAGAT
ATTCATCTATACGTCTGTACAGAAAAAAAAAGCTGCTATTTTTTTGTTCTTGATCTTTGTGGATTTAA
TCTATGAAAACCTTCAGGTCCACCCTCTCCCCTTTCTGCTCACTCCAAGAAACTTCTTATGCTTTGTACT
AGAGTGCGTGACTTTCTTCCTCTTTTCCCGGTAATGGATACTTCTATCACATAATTTGCCATGAACTGTT
GGATGCCTTTTTATAAATACATCCCCCATCCCTGCTCCCACCTGCCCCTTTAGTTGTTTTCTAACCCGTA
GGCTCTCTGGGCACGAGGCAGAAAGCAGGCCGGGCACCCATCCTGAGAGGGCCGCGCTCCTCTCCCCAGC
```

Figure 20 (Continued)

```
CTGCCCTCACAGCATTGGAGCCTGTTACAGTGCAAGACATGATACAAACTCAGGTCAGAAAAACAAAGGT
TAAATATTTCACACGTCTTTGTTCAGTGTTTCCACTCACCGTGGTTGAGAAGCCTCACCCTCTCTTTCCC
TTGCCTTTGCTTAGGTTGTGACACACATATATATATATTTTTTAATTCTTGGGTACAACAGCAGTGTTA
ACCGCAGACACTAGGCATTTGGATTACTATTTTTCTTAATGGCTATTTAATCCTTCCATCCCACGAAAAA
CAGCTGCTGAGTCCAAGGGAGCAGCAGAGCGTGGTCCGGCAGGGCCTGTTGTGGCCCTCGCCACCCCCCT
CACCGGACCGACTGACCTGTCTTTGGAACCAGAACATCCCAAGGGAACTCCTTCGCACTGGCGTTGAGTG
GGACCCCGGGATCCAGGCTGGCCCAGGGCGGCACCCTCAGGGCTGTGCCCGCTGGAGTGCTAGGTGGAGG
CAGCACAGACGCCACGGTGGCCCAAGAGCCCCTTTGCTTCTTGCTGGGGACCAGGGCTGTGGTGCTGGC
CCACTTTCCCTCGGCCAGGAATCCAGGTCCTTGGGGCCCAGGGGTCTTGTCTTGTTTCATTTTTAGCACT
TCTCACCAGAGAGATGACAGCACAAGAGTTGCTTCTGGGATAGAAATGTTTAGGAGTAAGAACAAAGCTG
GGATACGGTGATTGCTAGTTGTGACTGAAGATTCAACACAGAAAAGAAAGTTTATACGGCTTTTTTGCTG
GTCAGCAGTTTGTCCCACTGCTTTCTCTAGTCTCTATCCCATAGCGTGTTCCCTTTAAAAAAAAAAAAAA
GGTATTATATGTAGGAGTTTTCTTTTAATTTATTTTGTGATAAATTACCAGTTTCAATCACTGTAGAAAA
GCCCCATTATGAATTTAAATTTCAAGGAAAGGGTGTGTGTGTGTATGTGTGGGGTGTGTGTGTGAG
AGTGATGGGACAGTTCTTGATTTTTTGGGTTTTTTTTCCCCCAAACATTTATCTACCTCACTCTTATTTT
TTATATGTGTATATAGACAAAAGAATACATCTCACCTTTCTCAGCACCTGACAATAGGCCGTTGATACTG
GTAACCTCATCCACGCCACAGGCGCCACACCCAGGTGATGCAGGGGGAAGCCAGGCTGTATTCCGGGGTC
AAAGCAACACTAACTCACCTCTCTGCTCATTTCAGACAGCTTGCCTTTTTCTGAGATGTCCTGTTTTGTG
TTGCTTTTTTTGTTTTGTTTTCTATCTTGGTTTCCACCAAGGTGTTAGATTTCTCCTCCTCCTAGCCAGG
TGGCCCTGTGAGGCCAACGAGGGCACCAGAGCACACCTGGGGGAGCCACCAGGCTGTCCCTGGCTGGTTG
TCTTTGGAACAAACTGCTTCTGTGCAGATGGAATGACCAACACATTTCGTCCTTAAGAGAGCAGTGGTTC
CTCAGGTTCTGAGGAGAGGAAGGTGTCCAGGCAGCACCATCTCTGTGCGAATCCCCAGGGTAAAGGCGTG
GGGCATTGGGTTTGCTCCCCTTGCTGCTGCTCCATCCCTGCAGGAGGCTCGCGCTGAGGCAGGACCGTGC
GGCCATGGCTGCTGCATTCATTGAGCACAAAGGTGCAGCTGCAGCAGCAGCTGGAGAGCAAGAGTCACCC
AGCCTGTGCGCCAGAATGCAGAGGCTCCTGACCTCACAGCCAGTCCCTGATAGAACACACGCAGGAGCAG
AGTCCCCTCCCCCTCCAGGCTGCCCTCTCAACTTCTCCCTCACCTCCTTCCCTAGGGGTAGACAGAGATG
TACCAAACCTTCCGGCTGGAAAGCCCAGTGGCCGGCGCCGAGGCTCGTGGCGTCACGCCCCCCCGCCAG
GGCTGTACCTCCGTCTCCCTGGTCCTGCTGCTCACAGGACAGACGGCTCGCTCCCCTCTTCCAGCAGCTG
CTCTTACAGGCACTGATGATTTCGCTGGGAAGTGTGGCGGGCAGCTTTGCCTAAGCGTGGATGGCTCCTC
GGCAATTCCAGCCTAAGTGAAGGCGCTCAGGAGCCTCCTGCTGGAACGCGACCCATCTCTCCCAGGACCC
CGGGGATCTTAAGGTCATTGAGAAATACTGTTGGATCAGGGTTTTGTTCTTCCACACTGTAGGTGACCCC
TTGGAATAACGGCCTCTCCTCTCGTGCACATACCTACCGGTTTCCACAACTGGATTTCTACAGATCATTC
AGCTGGTTATAAGGGTTTTGTTTAAACTGTCCGAGTTACTGATGTCATTTTGTTTTTGTTTTATGTAGGT
AGCTTTTAAGTAGAAAACACTAACAGTGTAGTGCCCATCATAGCAAATGCTTCAGAAACACCTCAATAAA
AGAGAAACTTGGCTTGTGTGATGGTGCAGTCACTTTACTGGACCAACCCACCCACCTTGACTATACCAA
GGCATCATCTATCCACAGTTCTAGCCTAACTTCATGCTGATTTCTCTGCCTCTTGATTTTTCTCTGTGTG
TTCCAAATAATCTTAAGCTGAGTTGTGGCATTTTCCATGCAACCTCCTTCTGCCAGCAGCTCACACTGCT
TGAAGTCATATGAACCACTGAGGCACATCATGGAATTGATGTGAGCATTAAGACGTTCTCCCACACAGCC
CTTCCCTGAGGCAGCAGGAGCTGGTGTGTACTGGAGACACTGTTGAACTTGATCAAGACCCAGACCACCC
CAGGTCTCCTTCGTGGGATGTCATGACGTTTGACATACCTTTGGAACGAGCCTCCTCCTTGGAAGATGGA
AGACCGTGTTCGTGGCCGACCTGGCCTCTCCTGGCCTGTTTCTTAAGATGCGGAGTCACATTTCAATGGT
ACGAAAAGTGGCTTCGTAAAATAGAAGAGCAGTCACTGTGGAACTACCAAATGGCGAGATGCTCGGTGCA
```

Figure 20 (Continued)

```
CATTGGGGTGCTTTGGGATAAAAGATTTATGAGCCAACTATTCTCTGGCACCAGATTCTAGGCCAGTTTG
TTCCACTGAAGCTTTTCCCACAGCAGTCCACCTCTGCAGGCTGGCAGCCGAATGGCTTGCCAGTGGCTCT
GTGGCAAGATCACACTGAGATCGATGGGTGAGAAGGCTAGGATGCTTGTCTAGTGTTCTTAGCTGTCACG
TTGGCTCCTTCCAGGGTGGCCAGACGGTGTTGGCCACTCCCTTCTAAAACACAGGCGCCCTCCTGGTGAC
AGTGACCCGCCGTGGTATGCCTTGGCCCATTCCAGCAGTCCCAGTTATGCATTTCAAGTTTGGGGTTTGT
TCTTTTCGTTAATGTTCCTCTGTGTTGTCAGCTGTCTTCATTTCCTGGGCTAAGCAGCATTGGGAGATGT
GGACCAGAGATCCACTCCTTAAGAACCAGTGGCGAAAGACACTTTCTTTCTTCACTCTGAAGTAGCTGGT
GGTACAAATGAGAACTTCAAGAGAGGATGTTATTTAGACTGAACCTCTGTTGCCAGAGATGCTGAAGATA
CAGACCTTGGACAGGTCAGAGGGTTTCATTTTTGGCCTTCATCTTAGATGACTGGTTGCGTCATTTGGAG
AAGTGAGTGCTCCTTGATGGTGGAATGACCGGGTGGTGGGTACAGAACCATTGTCACAGGGATCCTGGCA
CAGAGAAGAGTTACGAGCAGCAGGGTGCAGGGCTTGGAAGGAATGTGGGCAAGGTTTTGAACTTGATTGT
TCTTGAAGCTATCAGACCACATCGAGGCTCAGCAGTCATCCGTGGGCATTTGGTTTCAACAAAGAAACCT
AACATCCTACTCTGGAAACTGATCTCGGAGTTAAGGCGAATTGTTCAAGAACACAAACTACATCGCACTC
GTCAGTTGTCAGTTCTGGGGCATGACTTTAGCGTTTTGTTTCTGCGAGAACATAACGATCACTCATTTTT
ATGTCCCACGTGTGTGTGTCCGCATCTTTCTGGTCAACATTGTTTTAACTAGTCACTCATTAGCGTTTTC
AATAGGGCTCTTAAGTCCAGTAGATTACGGGTAGTCAGTTGACGAAGATCTGGTTTACAAGAACTAATTA
AATGTTTCATTGCATTTTTGTAAGAACAGAATAATTTTATAAAATGTTTGTAGTTTATAATTGCCGAAAA
TAATTTAAAGACACTTTTTTTTCTCTGTGTGTGCAAATGTGTGTTTGTGATCCATTTTTTTTTTTTTTT
TTTAGGACACCTGTTTACTAGCTAGCTTTACAATATGCCAAAAAAGGATTTCTCCCTGACCCCATCCGTG
GTTCACCCTCTTTTCCCCCCATGCTTTTTGCCCTAGTTTATAACAAAGGAATGATGATGATTTAAAAAGT
AGTTCTGTATCTTCAGTATCTTGGTCTTCCAGAACCCTCTGGTTGGGAAGGGGATCATTTTTTACTGGTC
ATTTCCCTTTGGAGTGTAGCTACTTTAACAGATGGAAAGAACCTCATTGGCCATGGAAACAGCCGAGGTG
TTGGAGCCCAGCAGTGCATGGCACCGTTCGGCATCTGGCTTGATTGGTCTGGCTGCCGTCATTGTCAGCA
CAGTGCCATGGACATGGGAAGACTTGACTGCACAGCCAATGGTTTTCATGATGATTACAGCATACACAGT
GATCACATAAACGATGACAGCTATGGGCACACAGGCCATTTGCTTACATGCCTCGTATCATGACTGATT
ACTGCTTTGTTAGAACACAGAAGAGACCCTATTTTATTTAAGGCAGAACCCCGAAGATACGTATTTCCAA
TACAGAAAAGAATTTTTAATAAAAACTATAACATACACAAAAATTGGTTTTAAAGTTGACTCCACTTCCT
CTAACTCCAGTGGATTGTTGGCCATGTCTCCCCAACTCCACAATATCTCTATCATGGGAAACACCTGGGG
TTTTTGCGCTACATAGGAGAAAGATCTGGAAACTATTTGGGTTTTGTTTTCAACTTTTCATTTGGATGTT
TGGCGTTGCACACACACATCCACCGGTGGAAGAGACGCCCGGTGAAAACACCTGTCTGCTTTCTAAGCCA
GTGAGGTTGAGGTGAGAGGTTTGCCAGAGTTTGTCTACCTCTGGGTATCCCTTTGTCTGGGATAAAAAAA
ATCAAACCAGAAGGCGGGATGGAATGGATGCACCGCAAATAATGCATTTTCTGAGTTTTCTTGTTAAAAA
AAAATTTTTTAAGTAAGAAAAAAAAAGGTAATAACATGGCCAATTTGTTACATAAAATGACTTTCTGTG
TATAAATTATTCCTAAAAAATCCTGTTTATATAAAAAATCAGTAGATGAAAAAAATTTCAAAATGTTTTT
GTATATTCTGTTGTAAGAATTTATTCCTGTTATTGCGATATACTCTGGATTCTTTACATAATGGAAAAAA
GAAACTGTCTATTTTGAATGGCTGAAGCTAAGGCAACGTTAGTTTCTCTTACTCTGCTTTTTTCTAGTAA
AGTACTACATGGTTTAAGTTAAATAAAATAATTCTGTATGCA

>gi|55743135|ref|NM_001006932.1| Homo sapiens ribosomal protein S6 kinase, 90kDa,
polypeptide 2 (RPS6KA2), transcript variant 2, mRNA
GCGTCCCTTGGCTTCCGACATCCCGTCTGGCCGTCCCCCTGTGCCGGTCCGAGCCTCTGTTTATTTCCTT
TCCTACTATCAATACTCGACCAGCAGAAAAGGAAAGTTTAAAAATGCCAATCGCACAGTTGCTGGAACTA
```

Figure 20 (Continued)

```
TGGAAAAAGATCGAGGTGGAGCCTATGGAAATAGAGACCACAGAGGAGGATCTCAACCTGGATGTGGAGC
CCACCACAGAAGACACTGCAGAAGAAGAAGAAGGCGTCGTGAAGGAGATAGACATCAGCCATCATGTGAA
GGAGGGCTTTGAGAAGGCAGATCCTTCCCAGTTTGAGCTGCTGAAGGTTTTAGGACAAGGATCCTATGGA
AAGGTGTTCCTGGTGAGGAAGGTGAAGGGGTCCGACGCTGGGCAGCTCTACGCCATGAAGGTCCTTAAGA
AAGCCACCCTAAAAGTTCGGGACCGAGTGAGATCGAAGATGGAGAGAGACATCTTGGCAGAAGTGAATCA
CCCCTTCATTGTGAAGCTTCATTATGCCTTTCAGACGGAAGGAAAGCTCTACCTGATCCTGGACTTCCTG
CGGGGAGGGGACCTCTTCACCCGGCTCTCCAAAGAGGTCATGTTCACGGAGGAGGATGTCAAGTTCTACC
TGGCTGAGCTGGCCTTGGCTTTAGACCATCTCCACAGCCTGGGGATCATCTACAGAGATCTGAAGCCTGA
GAACATCCTCCTGGATGAAGAGGGGCACATTAAGATCACAGATTTCGGCCTGAGTAAGGAGGCCATTGAC
CACGACAAGAGAGCGTACTCCTTCTGCGGGACGATCGAGTACATGGCGCCCGAGGTGGTGAACCGGCGAG
GACACACGCAGAGTGCCGACTGGTGGTCCTTCGGCGTGCTCATGTTTGAGATGCTCACGGGGTCCCTGCC
GTTCCAGGGGAAGGACAGGAAGGAGACCATGGCTCTCATCCTCAAAGCCAAGCTGGGGATGCCGCAGTTC
CTCAGTGGGGAGGCACAGAGTTTGCTGCGAGCTCTCTTCAAACGGAACCCCTGCAACCGGCTGGGTGCTG
GCATTGACGGAGTGGAGGAAATTAAGCGCCATCCCTTCTTTGTGACCATAGACTGGAACACGCTGTACCG
GAAGGAGATCAAGCCACCGTTCAAACCAGCAGTGGGCAGGCCTGAGGACACCTTCCACTTTGACCCCGAG
TTCACAGCGCGGACGCCCACAGACTCTCCTGGCGTCCCCCGAGTGCAAACGCTCATCACCTGTTTAGAG
GATTCAGCTTTGTGGCCTCAAGCCTGATCCAGGAGCCCTCACAGCAAGATCTGCACAAAGTCCCAGTTCA
CCCAATCGTGCAGCAGTTACACGGGAACAACATCCACTTCACCGATGGCTACGAGATCAAGGAGGACATC
GGGGTGGGCTCCTACTCAGTGTGCAAGCGATGTGTGCATAAAGCCACAGACACCGAGTATGCCGTGAAGA
TCATTGATAAGAGCAAGAGAGACCCCTCGGAAGAGATTGAGATCCTCCTGCGGTACGGCCAGCACCCGAA
CATCATCACCCTCAAGGATGTCTATGATGATGGCAAGTTTGTGTACCTGGTAATGGAGCTGATGCGTGGT
GGGGAGCTCCTGGACCGCATCCTCCGGCAGAGATACTTCTCGGAGCGCGAAGCCAGTGACGTCCTGTGCA
CCATCACCAAGACCATGGACTACCTCCATTCCCAGGGGGTTGTTCATCGAGACCTGAAGCCGAGTAACAT
CCTGTACAGGGATGAGTCGGGGAGCCCAGAATCCATCCGAGTCTGCGACTTCGGCTTTGCCAAGCAGCTG
CGCGCGGGGAACGGGCTGCTCATGACACCCTGCTACACGGCCAATTTCGTGGCCCCGGAGGTCCTGAAGC
GTCAAGGCTATGATGCGGCGTGTGACATCTGGAGTTTGGGGATCCTGTTGTACACCATGCTGGCAGGATT
TACCCCTTTTGCAAATGGGCCAGACGATACCCCTGAGGAGATTCTGGCGCGGATCGGCAGTGGGAAGTAT
GCCCTTTCTGGGGGAAACTGGGACTCGATATCTGACGCAGCTAAAGACGTCGTGTCCAAGATGCTCCACG
TGGACCCTCATCAGCGCCTGACGGCGATGCAAGTGCTCAAACACCCGTGGGTGGTCAACAGAGAGTACCT
GTCCCCAAACCAGCTCAGCCGACAGGACGTGCACCTGGTGAAGGGCGCGATGGCCGCCACCTACTTTGCT
CTAAACAGAACACCTCAGGCCCCGCGGCTGGAGCCCGTGCTGTCATCCAACCTGGCTCAGCGCAGAGGCA
TGAAGAGACTCACGTCCACGCGGCTGTAGCGGGTGGGACCCTGGCCCCAGCGTCCCTGCCAGCATCCTC
GTGGGCTCACAGACCCCGGCCTCGGAGCCCGTCTGGCACCCAGAGTGACCACAAGTCCAGCAGGGAGGCG
GCGCCCGCCCTCGCCGTGTCCGTGTTTTCTTTTTCAGCCCCGGAGAGGGTCCTGACCTGGGGCTTCTCC
AAGCCTCACTGCGCCAGCCTCCCCGCCCGCTCTCTTTTCTCCCAAGCGAAACCAAATGCGCCCCTTCACC
TCGCGTGCCCGTGCGAGGCCGGGGCTTCTTTCAGAGCCCGCGGGTCCTCTCATACATGGCTTCTGTTTC
TGCCGAGAGATCTGTTTTCCAATTATGAAGCCGGTCGGTTTGGTCAGACTCCCGACACCCACGTCCCAGG
TACCCGGTGGGAAAGTGGCAGTGCGAGGGCGCAGCCATTGGTGGTTGCAGGGCCCCAGAGGGCTGGGGTG
ACCTGGCATCCCGGGGCTCCCACGGGCTGGATGACGGGGTTGGCACTGTGGCGTCCAGGAGGAGATGCC
TGGTTCTGCCCAAAATAATCCAAAGAGCCGTTTCCTCCTCGCCCTTCAGTTTTTGCCTGAGGTGCTGGGT
AGCCCATCCTTTCCTCTGTCCCAGATTCAAATGAGGAGTAAGAGCCCAGACGAGAGGAAGGCAGGCTGGA
TCTTTGCCTTGAGAGCTCCGTGTCACCAGGATGGAAGGGGTGCCTCTCGGAGGAGCCTGTGTCCACCTC
```

Figure 20 (Continued)

```
CAGTCTCGGCTTTCCCCGGGGGGCCAAGCGCACTGGGCTGCCGTCTGTCCCCAGCTCCCGTGGCCACACA
GCTATCTGGAGGCTTTGCAGGGAGTCGTGGGTTCTCGCACCTGCTCAGCCCTGTGTCGGCTTCCTGTGTG
CTCACCTAAAGCTGTGGTTTTGCTGTGTTCACTTCGATTTTTCTGGTCTGTGGAGAAACTGTGAATTGGA
GAAATGGAGCTCTGTGGCTTCCCACCCAAACCTTCTCAGTCCAGCTGGAGGCTGGAGGGAGACACAGGCC
CCACCCAGCAGACTGAGGGGCAGAGGCACAGGTGGGAGGGCAGCGGAGATCAGCGTGGACAGGAGCGATG
CACTTTGTAGATGCTGTGGCTTTGTGTTGCGTTTTGTGTCTCTGTTGCACAGATCTGTTTTTTCACACTG
ATCCGTATTCCCCTGGGTGTGCACACAGGGCGGGTGTGGGGCATTTAGGCCATGCTGTGCTCTACTTCAT
TGAGTAAAATCGAGTGAGAGGTTCCGGGCAGCAGGATCGACGCCCAGTCCAGCCGGCAGAGGGAACACAC
GGGTCCTTCATTGTCCTGTAAGGGTGTTGAAGATGCTCCCTGGCGGCCCCAAGCAGACTAGATGGGAGG
AGGCGCCGCTCAGCCCCTCACCCTGCATCACTGAAGAGCGGCGCCTCTGCAGCAAGCAGGGCTTCAGGAG
GTGCCCGCTGGCCACAGCCAGGTTTTCCCTAAGAAGATGTTATTTTGTTGGGTTTTGTTCCCCCTCCATC
TCGATTCTCGTACCCAACTAAAAAAAAAAAAATAAAGAAAAAATGTGCTGCGTTCTGAAAAATAACTCCT
TAGCTTGGTCTGATTGTTTTCAGACCTTAAAATATAAACTTGTTTCACAAGCTTTAATCCATGTGGATTT
TTTTTTTCTTAGAGAACCACAAAACATAAAAGGAGCAAGTCGGACTGAATACCTGTTTCCATAGTGCCCA
CAGGGTATTCCTCACATTTTCTCCATAGAAGATGCTTTTTCCCAAGGCTAGAACGACTTCCACCATGATG
AATTTGCTTTTTAGGTCTTAATTATTTCACTTCTTTTTAGAAACTTAGGAAGAAGTGGATAATCCTGAGG
TCACACAATCTGTCCTCCCAGAAATGAACAAAAGTCATCACCTTTTCTGCTTGCTACACAGGCAACGATT
CCCCCATCAGCTGCCCGGACCCTTTGGCCTGGCTTGGTGTGCAGGCCTGTCTGTTTGCTTAAAGTCAGTG
GGTTCTGGTGCAGGGAGTGAGAAGTGGGGAAGTGAAAGGGAAAGCATCCGTGAGAAAGCGGCCACGGTT
TTCCCTCCTTGTGTGCCCATGGGGCACCAGCTCATGGTCTTTTTCAGTCATCCCAGTTTGTACAGACTTA
GCTTCTGAACTCTAAGAATGCCAAAGGGACCGACGAGACTCCCCATCACAGCGAGCTCTGTCCTTACATG
TATTTGATGTGCATCAGCGGAGGAGAACACTGGCTTGGCCCTGCTCCGCTGAGTGTCTGTGAAATACCTC
TACTTTCCCTCCCATATCCAGAACAAAATGATACTTGACATCCTTCCACAAAAGTCAGCCTAAAGAAGTT
ATGGTATCATATGTTAAACTAAGCTTTCAAAAACCTTAGTGAAATAGCAAGTGACTGCTTTCAAGCAGCA
GTCGACATGTAAATGAAGGTGTTCTTAGAATTCGCATTTTGCCAGCTCAGCGCACCTCCACAACGAATGA
AATGCTCCGTATGATTTGCACAAATGACATAGACCTCCCCAAAAGTTAACTGGCTCTCCTTCCTCACACA
GTTCATCATAACCCAACCCCCCACCCCCGGGTCATGAAAATCACAGAACTTATAAACACATTGAACCCTA
GATCTCAGGCTTCCTGACCTACCGCCAGTGGCCCCTTGCTGGCCACCCTATAGGGTCCTCCTTCCCTGGC
AGCCCCCATGTGGGAGAAATACCTGATTCTCCCAATCTGCAGTGGGAGAGCTTTGCTGAATTCCATCCC
AAAGTCAAACATGGGCAAGAGGTGAGGATTTCACTTTTACCCTCAAGTCCGATTTGTCTGTGATTTTAAA
CTAACTGTGTATGTATTGATGTTTGGAAGATTGTTTGAATTTTAAAGTGATAATAGTACTTAATGTTATC
CAGTATTGTTCATTAAATGGTGTTATCCTAAAGCTGCACTTGGGATTTTTACCTAACGCTTTACTGATTC
TCTCAAGCACATGGCAAAGTTTGATTTGCACTCCGTTCATTTCTGACACGTTTTGCTGCCTCCTACCTTT
CTAAGCGTCATGCAAATTCGAGAATGGAGAAGGACGCTGCCGGTCCCTGAGCGGTGTGGAGAGGGCGGAA
GGTGGACTCCAGCGCAGCTTGAGGGGCTGAGGACGGAGGCTGCAGCATCTGTGTCGTTCTACTGAGCACG
CTTCTCTGCCTCGCTCCTGACTCAGCACTTTGTTCACTGGCTCAGCAGTTATGTTTACACATCATTTTTA
TGTTCCTGCTTTGTAATTCATGTTTGAGATGGGTGGCCACTGTACAGATATTTATTACGCTTTCCAGACT
TTCTGAATAGATTTTTTTGAATAAACATGGTTTTATGAAGTGTAATCTTTTTCTAGCCTAACAAT

>gi|110349737|ref|NM_001032296.2| Homo sapiens serine/threonine kinase 24
(STK24), transcript variant 2, mRNA
TCGGCGCTCGCGGGCTCGGCGGGCTGTGCGCGCCCACTCCGGCTCCAGCGGCCAGCGCGCGCGGGCCCAG
```

Figure 20 (Continued)

```
GCCGCCCGGCTCCAGCCCAGCAGTAGCGGCAGCAGCGGCGGCGGCGGCAGTGCGCGCGAGGCCCTGCGCC
CCCAGCAGCTCCTCCCTGGCGCCGTGCATGGAGACGCGGCCCGCCACCCGCCGCTGAGCCCCCGCCGCCC
GGCCGGGACCCGCCAGGGCTGGGGTGGCCTCGGGCTCCGGCCGGCCCCGCCGCCCGAGGGCTGCGCGCGG
CCCGCGGGCCTCGCCGCCCCGCGCGGATCGTCGCGGCCCGGCCGTCCCGTCCCAGGAAGTGGCCGTCCTG
AGCGCCATGGCTCACTCCCCGGTGCAGTCGGGCCTGCCCGGCATGCAGAACCTAAAGGCAGACCCAGAAG
AGCTTTTTACAAAACTAGAGAAAATTGGGAAGGGCTCCTTTGGAGAGGTGTTCAAAGGCATTGACAATCG
GACTCAGAAAGTGGTTGCCATAAAGATCATTGATCTGGAAGAAGCTGAAGATGAGATAGAGGACATTCAA
CAAGAAATCACAGTGCTGAGTCAGTGTGACAGTCCATATGTAACCAAATATTATGGATCCTATCTGAAGG
ATACAAAATTATGGATAATAATGGAATATCTTGGTGGAGGCTCCGCACTAGATCTATTAGAACCTGGCCC
ATTAGATGAAACCCAGATCGCTACTATATTAAGAGAAATACTGAAAGGACTCGATTATCTCCATTCGGAG
AAGAAAATCCACAGAGACATTAAAGCGGCCAACGTCCTGCTGTCTGAGCATGGCGAGGTGAAGCTGGCGG
ACTTTGGCGTGGCTGGCCAGCTGACAGACACCCAGATCAAAAGGAACACCTTCGTGGGCACCCCATTCTG
GATGGCACCCGAGGTCATCAAACAGTCGGCCTATGACTCGAAGGCAGACATCTGGTCCCTGGGCATAACA
GCTATTGAACTTGCAAGAGGGGAACCACCTCATTCCGAGCTGCACCCCATGAAAGTTTTATTCCTCATTC
CAAAGAACAACCCACCGACGTTGGAAGGAAACTACAGTAAACCCCTCAAGGAGTTTGTGGAGGCCTGTTT
GAATAAGGAGCCGAGCTTTAGACCCACTGCTAAGGAGTTATTGAAGCACAAGTTTATACTACGCAATGCA
AAGAAAACTTCCTACTTGACCGAGCTCATCGACAGGTACAAGAGATGGAAGGCCGAGCAGAGCCATGACG
ACTCGAGCTCCGAGGATTCCGACGCGGAAACAGATGGCCAAGCCTCGGGGGGCAGTGATTCTGGGGACTG
GATCTTCACAATCCGAGAAAAAGATCCCAAGAATCTCGAGAATGGAGCTCTTCAGCCATCGGACTTGGAC
AGAAATAAGATGAAAGACATCCCAAAGAGGCCTTTCTCTCAGTGTTTATCTACAATTATTTCTCCTCTGT
TTGCAGAGTTGAAGGAGAAGAGCCAGGCGTGCGGAGGGAACTTGGGGTCCATTGAAGAGCTGCGAGGGGC
CATCTACCTAGCGGAGGAGGCGTGCCCTGGCATCTCCGACACCATGGTGGCCCAGCTCGTGCAGCGGCTC
CAGAGATACTCTCTAAGTGGTGGAGGAACTTCATCCCACTGAAATTCCTTTGGCATTTGGGGTTTTGTTT
TTCCTTTTTCCTTCTTCATCCTCCTCCTTTTTAAAAGTCAACGAGAGCCTTCGCTGACTCCACCGAAG
AGGTGCGCCACTGGGAGCCACCCCAGCGCCAGGCGCCCGTCCAGGGACACACACAGTCTTCACTGTGCTG
CAGCCAGATGAAGTCTCTCAGATGGGTGGGGAGGGTCAGCTCCTTCCAGCGATCATTTTATTTTATTTTA
TTACTTTTGTTTTTAATTTTAACCATAGTGCACATATTCCAGGAAAGTGTCTTTAAAAACAAAAACAAAC
CCTGAAATGTATATTTGGGATTATGATAAGGCAACTAAAGACATGAAACCTCAGGTATCCTGCTTTAAGT
TGATAACTCCCTCTGGGAGCTGGAGAATCGCTCTGGTGGATGGGTGTACAGATTTGTATATAATGTCATT
TTTACGGAAACCCTTTCGGCGTGCATAAGGAATCACTGTGTACAAACTGGCCAAGTGCTTCTGTAGATAA
CGTCAGTGGAGTAAATATTCGACAGGCCATAACTTGAGTCTATTGCCTTGCCTTTATTACATGTACATTT
TGAATTCTGTGACCAGTGATTTGGGTTTTATTTTGTATTTGCAGGGTTTGTCATTAATAATTAATGCCCC
TCTCTTACAGAACACTCCTATTTGTACCTCAACAAATGCAAATTTTCCCCGTTTGCCCTACGCCCCTTTT
GGTACACCTAGAGGTTGATTTCCTTTTTCATCGATGGTACTATTTCTTAGTGTTTTAAATTGGAACATAT
CTTGCCTCATGAAGCTTTAAATTATAATTTTCAGTTTCTCCCCATGAAGCGCTCTCGTCTGACATTTGTT
TGGAATCGTGCCACTGCTGGTCTGCGCCAGATGTACCGTCCTTTCCAATACGATTTTCTGTTGCACCTTG
TAGTGGATTCTGCATATCATCTTTCCCACCTAAAAATGTCTGAATGCTTACACAAATAAATTTTATAACA
CGCTTATTTTGCATACTCCTTGAAATGTGACTCTTCAGAGGACAGGGCACCTGCTGTGTATGTGTGGCCG
TGCGTGTGTACTCGTGGCTGTGTGTGTGATGAGACACTTTGGAAGACTCCAGGGAGAAGTCCCCAGGC
CTGGAGCTGCCGAGTGCCCAGGTCAGCGCCCTGGACTGCTTGCGCACTTGCTCACCGAGATGATGCAGTT
GGAGGTTGCTGATCTGTGCGATTGCTGTAGCGGTTGCCGGGGACCTTAAGAGTTATTTTGCTTCTCTGGA
AGGGGCCTATGCTTGCTAGGCAGGCAGCCAGTGTGTCTGTTTTTCTTGGTTTGCTGTGGGACCTTGCTTG
```

Figure 20 (Continued)

```
GCGAGGGGGAAAATCTCTGGGTTTCTGGAGTGGGAGGGTTCGTGCAGCAGCTGTTGACTGGTACATGAAG
CATTCTTTTATGTTTGTTGAAGCTGATGATTGACATCTCCCGTGGGTGTGCCAGTTCTTGTGGAGTTAAG
ACAGGATTTTTGGAAGCAAGGAAGTTAGTGGGTGAGCTTGGGGATGTAGCTCAGCTATCTGCTGGTCTAG
TGGCCTCTAAGCTATAGGGAGGGGACAGAGCCCTGAGCTACAGATGCTTGAGTGGGTTATTGTGTCGGTT
TGCTAGTGCAGTCTGGTTTTTAAGCTCTAAAATTGAGGTATTTTATTAGAAGTGGATTTGGGTTGAACTC
TTAATTTGTATAAGGGATATATTTTGGTTGGGGAAATAGAACTGAGTTGCTAATTCTTATTGTACTCATT
ACTCCATACAAGAATGTTATGTTGAATAATAAAATTGGAGAAGATTTCATTTTGTGTTTCCAGGGAGTAT
TCTGTGTGGGGAACTGTTTCCTTACGTGAGGCCGGCGGCATAAGTCAAAGATGAGTTTTGTCCTTGCGAA
TCACACAGATTGAGTCTGTGTTCCCCAGGGTGTGCCGTTACCTGATTTTTAAGTGAGCCAGGGCGGACAG
CAGCTTTTCTGATTTACAGAGTTCTTCAGATTTACAAATGGACAATGACATCACAGTTTTTAGCACTGAA
GCCAGTCTCATGCTAGTAACAGTGGGTGAGCCGCTCGAGGGACTGGGTTCTAATGAATACTGGTATGAAC
GGGGAGTCTCTGCAGTCGCCAGACAAATCATACTCAGCCCCTTCCCCGTAGAGCAACAAGTGGTTCTTT
TAGAGTTGACTGGCAGCATTTCCTGTCGGGGAGGTGGGGTTTGATGGAGTTAGAAAGCTCGCCTCTGTG
TACATTCTCTCCTGGGCTGTTACTTTCTGTAGACGCACAAAATCAGCCCCAATGTTTTTAAGGGCATCTT
AGCCAAGGAAGCTGGCTTTTGTGTCGCCACTTCCAGGCCTGCATTAAGAGAGAGCCCAGGCACCAGGGCT
ACCACTGGAACCTGCCTCAGCGTCAACTGCTGCTGGTCTGTAGCCAGGCCCAGCCTTTGAGACGGGTTTA
CTGTCACCAGTAGCCTCTCAGTGCCAGCCCTGAGCTGCTCCTGGCTCAGCTGCCCAGAGCCTGCAGCCTG
GGGAGGTACTCAGCCTCTGGGAGACGAGGGCCGTGGACTGGGTGGCTGGTAGCTCCTGCGTTTTTGAGCT
GTGTCCTGGCTGGCTGCTGCCAATGAGGTGGACACCAGTGTGGTTTGGGGTGCACTGGCCACTTCTTGCT
GGGTTCTGATTTTCTTGGAAGTGCATCTGCCTTCCTTATCCAATAGTTTTATCCCTGCATTGCTCTTGTG
AAGTGGCTGGTTTGGTTCTGTATGTAGCATTTTGTACCTTTCCTCTGGCAAAACACTGTCAGTTTATAAA
CATTTTTTATATTTCCCTCCTTTAAAAACAGCTTGTGTATTTCTGCTATAAAATGTGTCAGCAAAGGCAG
AGTGACCTAATAGGGCATGTTCTTAAGCACAGGGACTGTATCATGCAGGGGCCAATAAAGCTCAAGAAAA
CGAG

>gi|131888820|ref|NM_001033551.2| Homo sapiens target of myb1-like 2 (chicken)
(TOM1L2), transcript variant 1, mRNA
AGAGACGCGGCAAGGGGCGGGGCCAAAGGCCCTAAGCTCGGCGTTCCAGAGAGTGGGGAGGGGCAAGT
GTCAGTCAGGACGGGAGTCCGGCGGGTTACAGCGGAGGCCTAGGTGGCAGACAGGGGGCCCGGGCCGCTG
CGTGTTGTCCACCCAAGATGGAGTTCCTCCTGGGGAACCCGTTCAGCACACCAGTGGGGCAGTGCCTCGA
AAAGGCAACAGATGGCTCCCTGCAAAGTGAGGATTGGACGTTGAATATGGAGATCTGTGACATCATCAAT
GAGACGGAGGAAGGGCCAAAGGATGCCATTCGAGCCCTGAAGAAGCGGCTCAACGGGAACCGGAACTACA
GAGAGGTGATGCTGGCATTAACAGCATGGGCTGATGCCTTTCGAAGCAGTCCTGATCTCACCGGCGTTGT
GCACATATATGAGGAGCTGAAGAGGAAAGGGGTTGAATTTCCCATGGCAGACTTGGACGCTCTGTCTCCC
ATACACACACCACAGCGGAGTGTCCCTGAAGTGGATCCAGCTGCGACCATGCCCAGGTCCCAATCACAGC
AGAGGACAAGTGCTGGTTCCTATTCCTCGCCGCCTCCTGCTCCCTACTCCGCACCGCAGGCCCCAGCTCT
GAGTGTGACTGGCCCCATCACAGCCAATTCAGAACAGATTGCCAGGCTGCGGAGTGAACTGGACGTCGTT
CGAGGAAACACAAAAGTCATGTCTGAGATGTTAACAGAAATGGTCCCTGGACAGGAGGATTCATCTGATC
TGGAGTTGCTGCAGGAGCTCAACAGGACCTGTCGGGCCATGCAGCAGCGCATCGTGGAGCTCATCTCCCG
CGTGTCCAATGAGGAGGTCACCGAGGAGCTGCTGCATGTGAACGATGACCTCAACAACGTCTTCCTTCGA
TACGAGAGGTTCGAACGATACAGGTCTGGCCGATCCGTTCAAAATGCCAGTAATGGAGTACTGAATGAAG
TAACCGAAGACAACTTAATAGACCTGGGGCCAGGGTCTCCAGCCGTGGTGAGCCCAATGGTGGGGAACAC
```

Figure 20 (Continued)

```
AGCGCCCCCATCTTCCCTCTCCTCCCAGCTTGCAGGCTTAGACTTGGGGACAGAGAGCGTCAGTGGCACC
CTCAGTTCACTCCAGCAATGTAATCCCCGTGACGGCTTTGACATGTTTGCCCAGACGAGAGGAAACTCCT
TGGCTGAGCAGCGCAAGACGGTAACCTATGAGGATCCTCAGGCTGTCGGAGGACTTGCTTCTGCACTAGA
CAATCGAAAACAGAGTTCAGAAGGGATCCCCGTTGCGCAGCCATCTGTCATGGACGACATTGAGGTGTGG
CTCAGGACCGACCTGAAGGGTGATGATCTGGAGGAGGGTGTCACAAGTGAAGAGTTTGATAAATTCCTTG
AAGAAAGAGCCAAAGCTGCTGAAATGGTTCCCGACCTCCCCTCGCCCCCATGGAGGCTCCTGCCCCAGC
CTCAAACCCTTCTGGCCGGAAGAAGCCAGAGCGGTCAGAGGATGCCCTCTTCGCCCTGTGAGCAGCTCTG
TGGTTTGCCTCCCAGATGGCGGGTCCCCGCTCGCACCCCGTGGACACCGGGCACTGGCCACTCCTACAT
CCCCAGCTCCACACGGCCTGCACACCTGTGTTTCCATGGAAATGCCACCGTGTCTGCTCCCAGGCCTCCC
ACTAGTCAGGACCAGCTTCAGCCACTTCTTTTCTCTGAGTGGTGGGACAACTGCAGCCAGAGACTCTCTC
CCCTCCCACCATGGGCCCCTCTGCCCATGTTTCCTCCCAGGAAGAGCGGGCAGAGTGGCCCAGCCCCAGG
CAGTGCTTCCTGAGCAGACCACCCGGACTGTCTTTCCTCCACCCGCCCATGGAGAAAGAGCACGCCCGGC
CCCGCCCTGTGCTCACCTCTGCCTGGCTCAGCGACCTTCTCAGGCATTCTGCCCTCCTGGGCCCCTCTCT
CCCTGAAGGGGCTTTGTGGCATCTCTGGAAGAGCAGGGTGTGCTGCACTCATGGGCCTGGTCTCACTCCT
TGGACTTGTCACCTTGTGACATTTGGCTTATCAGCATTTGAGAAGGCTCTGCTGGGTCTCCATGGTGGGG
GTCTCTCACCTTCTTGACCCTCTCTCCATCATTCAGCTGCCAGCCCAGGCTTCACACCCAAGCTGGCTCA
GCAGCCGAGCCTGGCACCGAGGGTCCCTGCAGGCTCCCTGGGCAGGGAGAGGGCCAAGGACAATTGGGAG
GGCAGCAGGCAGCCCGCAGATGGTGGCCATGTGGCACGCTGCTGAGACGACACTACCAATAAACCAAACT
GCCACGCACACACTGCAGGCTCACACCCGCACACCTGGTCCTGGCTTGTGGAGGGACTTGCACTGGAGGT
ATTGCTCTGGCTTGCCTGGGGAAGTGTCACAGATGTGCACATGGGCCACACTCAGTGCTGTGGCCTGGCC
TGCCGTAGCCTCACACATCTGCCTCAAGAGCCAGCAGCAAACAGCTTTGTGGCATCCTTGGAGGTTCCCA
GTGACTGAGAGGCCTGGGCAGCACTAAGGCCCCTGCTCTGCTCCCTGGCATAGGCCTTGGCCTCCTTGCA
CAGACTCTCCTGACAGTCTGGCCTCCTCCCACCTCAGAGGTCCTCTGGCCACCAATTTATACTCTCTCCC
CAAGCTGATCCTGAAGGCAGGCAGAGCAGCTAGGGGCTGGTAACATGTATTCCCATCCCGTGTCCTCACT
GGTGTGTCTCCTGGCCATGGGCAAGGGACTCGGGTCATCCCAGGCCCTGGTCCAGCCAGACACCTGGCCC
CACACCTCCCACCAGGCTGCTGTTGCTCAGAAGGAGAATACTGCAGCTGTATGCATCCCCGTGTGTCTTG
GGCCCAGCTCGCTGGGTCAGTCTGCTCCTGTCCCCTCCAGCATGCACTGCCTAGGTCAGCACAGGTTCCT
GATCCATGGTGTAGTTAGCCCTTCCCACCTGGCAGGACGGCCCAGACCACCAGCCAAGCAGGGAAAGGGG
GCTGGGCTTGACGGGAGAAGAGACCAGCGACATGGTCGTTGGGGAGCATTCAGGATGGCGACTTCAGCTG
GGGGTCATGCTGAGCACCAACAGGAACTATTCCAGTGAAGAGCAAGTGCTGCCCGACCCAGGACCCTGTG
CCAGGCTAGCAGCCCTCCAGCTCCCTCCAGAGAGGAAACCTCTGTCTGGCTGAGGGTGGGACTAGCTGGG
ATGTCTCACTCCAGTTGCTCAGGTTCACCCAGGAAGCTCCTCCGTGGAGTGGCCAGCCTGATTCTAGCCC
TGTCCTCTCTGGCAGCACATGCCACACCTGCCTGGGCCTTCTGCTCCCTGATGCTTGATGAGCCCCTGCC
TCCTCAATGTTTCTCAAAGACAGACCCCCTGAGGCCAGCTTGAATGTGAAGACTGCTGAAGTTAGCTGG
CTTCACTTGAGCTGCAGAAAAGGTGGCTGGGATGGCCCAGGTGCACCCAGAGGCCCCAGCCCTTTGGCTG
CCTTTGGGTTGTGACTTGGGTTGTCTCTGAGGCCCTGCCAGAGCTGGGCCTGCGGGTGGTGGGCGGTCCG
ACCTCGGGCAGTCAGTGCTCCGCAGCCTCAGCACTGCATCCCAGACCCAGTGTCCTCAGAGGGAAGAGCC
AGCCTCCCTGCCTCATGGAACCAGGAGTCCCAAAAAGTCAGGAGCCTGGAGGCTCTGAAAGGAGCAGGGA
TTCCATAGTGCGTGAAGCTGAAATAGGCGCCCTCCTGGGGAGCCCCAGCAAAACTGTTTTTCATACCCA
CTCCCAGAACTGCCCCGCTCCAGCTCCAGCGCCAGCGCCAGCTGGTTGCCAGGCATCATTGGAGAGGCCT
GGCTGCCCCAGGGGCAGCAGGGAGTGGTGGACCTGTATGGGCTGGCAGGAGGCCATTGGCCATGCTGACA
AGTGTCACCTGCCTTCCTAGCCTGGAGCCACCCCTCAGGTGGCCTGCTTGCACCTCCTATCCGGAGGTAG
```

Figure 20 (Continued)

```
CCTGCCCCACCTGTAGGCAGAGGGGGCTCTTGCTTGAGGCCTGCACAGGAAGCAAGTATAGCCCCGGTGC
CCCAGAGTGGGTTCCACTTAGCCCTGGCGAGATGGCCTGTCCTGAGATCTCTGCTCCCAGACCCCACCAT
CTGGGGAGCACAGTCCTTAGGCTGCCTGGTCCAGGAAGGGGGTGCGGCTCTGTCAGGAAACCTGGACTCT
CAAGGCCACCAGCCTCTCCGTGAGTGTTAGAAATCACAGATACAGTATATACTTAATTACACTAAATTA
TTGCTGGGATTCCTTATAAGCACTAATTATACCTGATTATAGGTTAAAATATTTATTTTGTCAAAATATT
TTCTTGGGAATGTGTTTAACCCTTTCTGCGTTCATTGTTGCTGAGATGTGAAAACTAACCATTCCCTCCT
GCCTACCTTTTTGGCCACTGGGCGGCAGAGAATGGCGCTATGTGCAGTTGGGCCCCTGGCACCATGGGCC
TTTGGCCTGCCTGCTGCAGAGTAGCCCTGCCTGGGCAGTCTCCAGGCACTGAGCAGGCCATCTGTGGCCA
GGCTGAGAGAATGACTGGCTCGCTTACCAGCGTGCATGGACAAGGAGCTTTGGAGCCTCAAGGGGTTGT
TGCTGGCCTGGGCTAGAGGGAAAGGTGACCATCCGTCTGTCCTCCTGTCTTTCTATTAGCGCCTCCATGT
GAGTGATGGTGCCTTGGTTCACTAGCCTTCCCCCACCACCCCACCATGCCACCTGGTGGTCTTGGGGCCT
GTGCTGTCACTCCAGCCCTGGGGAGGAGAGGACCCAGCCCGGAGAGTTGGGCAAGGGCTCCACATGGC
CCAAGGGCAACAGATGCTCGCAGGGCAGCTGCTGCCGATGCTCACGCTCCTGCCCCCCTCCTTCCCGCTG
CCACACCCCACCCTGGGCCCCCGCAGACACGCATCTCTAACTCAGTTGGGCCCAGCCTTCTGGATGGCTT
GGGGTAGGCCATGGGCCCACCTGGGGCCAGGCCAGCCCCTGGGGCAGCTCTGGAAGAGCAGTGTGGAGGA
GCACTTGCTTGCAGCCTGGCTTCAGCCTCTGGCACTGCTGGAGTGGTCCCTGGGAGCTTCTGCACTGTCG
GCTTTGGGGACGTCTCACCCACTTGGGTTACAGTAGGCCTTCCCCACCCAGAGAGAAGTGTTTCCACCCC
AGAGACATTGTCTGTCAGCCCCTGAAGTGCTCGCCTCCCCAGTGCCCGTCACCAGCCCTTCCTATCTGT
GGGGTCCAAGTCAGGCTTCCCCTGCGGCCACCAGCCATAGGGAGCAGCCATCAGCCCCGAGTCAGAACT
GCTTCTGTCTGTCCATACCTCCAGGCTCTCCCGGAGAGGGGACGGATATTTATTTCCTAAAGTTTGCAC
TTAATTGTGAGGATTCTCAGGATTGTTGGGGGCTACTGAAAAGAGGAATGTGTTGAATGTCGCGTTTGCT
GTCCACTCGTCCTAGAAGTTTAGTGTTTTTGTCACTGTCATGTGTTTCTGTGGGCAGAGCTGGTTCTGGA
GGGTGGGTCAGTGCACCCGAGGCTCAGAGCATCCATCCACCCCACTGGCCCTCCTTCCAGATACCCTCTC
TCTAATTGGGTTCTTGCATGTAAAATACTCCACAATAAATAAATAATTGAACAAATTAAAAAAAAAAAAA
AAAAA

>gi|212549749|ref|NM_001221.3| Homo sapiens calcium/calmodulin-dependent protein
kinase II delta (CAMK2D), transcript variant 3, mRNA
AAAGGAGGGAGTGCGAGAGATCCACGAAGGGACAGGCTTGGAGTCGCTAGAGGGAGGTGTGGGACCAGCG
AGGAGGGGGCTTCGCCAGGGAGGGGGTGCTGGCAGGCGGAGGGAGCGGCGGGAGGAGGCGCCGGAGGAGG
AGACGGAGGCCTGGGGACGGCAGAAGAGGCTTCGCCTGAGCCGAGCGCTCTTTCTCTCGCCGCGCCGTCT
TGAAGCCGCGCGGGCTCGTGAGCAGCGCGAGGCCGCCAAGGTGCCTCGCTTCGCCGGAGCCGCTGCCGCC
CGCCGGAGGGAAGCCGGCCTCGGGCGCGCACGCTCGTCGGAGCCCCGGCGCGCCCCGCGCCTGAGCCTGC
TGACAGCGGCCGCTGGGCTCAGGCTGTCCGCTCTGGGCTCCGCGGCCTCGGCCCCGCTGCACTCCACCTC
CGCCCCTCGGACTCCCTCCCCTCTGCTTCTACTCCTCCTGCTCCAGTGCGGATCGTTTCGCAACTGCTT
GCCACTCGTCCCGTGCCTGGCTGTTTTTCCATTTCCCGGCCCCTCTTCTTGAGTACTTTACCCCCTGCA
TTTGGGGACAGGGACTGGAAAAGGGGCGGGTGGAGCGTCCAGTGGAGAAGAAGGAAGCGAGGCCCGCAGG
AGGAGGAGGATCGGCGGACTGTGGGGAGGAGACCCACGCCACCCTTTCTGGTCATCTCCCCTCCCGCCC
CGCCCCTGCGCACACTCCCTCGCGGGCGAGCTACTTTCGGACCAGGAAAGTAAGAGCGGCCCTGGGTGAC
AGCGCCGCGGGCCAGTCCCGGGGTTAGCCGCGCGTCTGCTCGCTTCTGGTCCGTCGCGCTCCCAGCCAG
GGCACAGCCCGGACCGAGGATGGCTTCGACCACAACCTGCACCAGGTTCACGGACGAGTATCAGCTTTTC
GAGGAGCTTGGAAAGGGGGCATTCTCAGTGGTGAGAAGATGTATGAAAATTCCTACTGGACAAGAATATG
```

Figure 20 (Continued)

```
CTGCCAAAATTATCAACACCAAAAAGCTTTCTGCTAGGGATCATCAGAAACTAGAAAGAGAAGCTAGAAT
CTGCCGTCTTTTGAAGCACCCTAATATTGTGCGACTTCATGATAGCATATCAGAAGAGGGCTTTCACTAC
TTGGTGTTTGATTTAGTTACTGGAGGTGAACTGTTTGAAGACATAGTGGCAAGAGAATACTACAGTGAAG
CTGATGCCAGTCATTGTATACAGCAGATTCTAGAAAGTGTTAATCATTGTCACCTAAATGGCATAGTTCA
CAGGGACCTGAAGCCTGAGAATTTGCTTTTAGCTAGCAAATCCAAGGGAGCAGCTGTGAAATTGGCAGAC
TTTGGCTTAGCCATAGAAGTTCAAGGGGACCAGCAGGCGTGGTTTGGTTTTGCTGGCACACCTGGATATC
TTTCTCCAGAAGTTTTACGTAAAGATCCTTATGGAAAGCCAGTGGATATGTGGGCATGTGGTGTCATTCT
CTATATTCTACTTGTGGGGTATCCACCCTTCTGGGATGAAGACCAACACAGACTCTATCAGCAGATCAAG
GCTGGAGCTTATGATTTTCCATCACCAGAATGGGACACGGTGACTCCTGAAGCCAAAGACCTCATCAATA
AAATGCTTACTATCAACCCTGCCAAACGCATCACAGCCTCAGAGGCACTGAAGCACCCATGGATCTGTCA
ACGTTCTACTGTTGCTTCCATGATGCACAGACAGGAGACTGTAGACTGCTTGAAGAAATTTAATGCTAGA
AGAAAACTAAAGGGTGCCATCTTGACAACTATGCTGGCTACAAGGAATTTCTCAGCAGCCAAGAGTTTGT
TGAAGAAACCAGATGGAGTAAAGGAGTCAACTGAGAGTTCAAATACAACAATTGAGGATGAAGATGTGAA
AGCACGAAAGCAAGAGATTATCAAAGTCACTGAACAACTGATCGAAGCTATCAACAATGGGGACTTTGAA
GCCTACACAAAAATCTGTGACCCAGGCCTTACTGCTTTTGAACCTGAAGCTTTGGGTAATTTAGTGGAAG
GGATGGATTTTCACCGATTCTACTTTGAAAATGCTTTGTCCAAAAGCAATAAACCAATCCACACTATTAT
TCTAAACCCTCATGTACATCTGGTAGGGATGATGCCGCCTGCATAGCATATATTAGGCTCACACAGTAC
ATGGATGGCAGTGGAATGCCAAAGACAATGCAGTCAGAAGAGACTCGTGTGTGGCACCGCCGGGATGGAA
AGTGGCAGAATGTTCATTTTCATCGCTCGGGGTCACCAACAGTACCCATCAAGCCACCCTGTATTCCAAA
TGGGAAAGAAAACTTCTCAGGAGGCACCTCTTTGTGGCAAAACATCTAAGGCCTGAAAACCATTCACATA
TGGGTCTTCTAAATTTCAACAGTGCCACTTCTGCATTCTCTGTTCTCAAGGCACCTGGATGGTGACCCTG
GGCCGTCCTCTCCTCCTCTTCATGCATGTTTCTGAGTGCATGAAGTTGTGAAGGTCCTACATGTAATGCA
TATGTGATGCATCATCTTATCATATATTCCTTCCTATACATTGTTTACACTTCAACTACGGGATGTTCC
ACACAAACTTAAATTACTGTTGGCAAAACAATAGGGGGAGATTAGACAAAAAAAAAATCCACAATATTC
CAAGTACAACTCTTCATCAAGTTTCTCTGTTAATGCCAAGATTTAACAGACTTAAGAACTATTGTTCTCT
GAATGACAGTTGTAAGAGAAATGTAAATTTTTTAGAACTCTTTGCTGTTAATCTGTTTTGGTTTGTTTGG
TTTTTTTTTTTTTTTAAGGTAAAAAAAAAATACACCTTCAGTTTCCTGGTGTGATCCTGGTTAAAATG
GATGATTTTTCATTGAAAGTTTTGCTGATTAACAATTAAAGTGGGATGATATGTGGGCAAAATCACTTAT
GAAAGTAGAAGCAAGAATCAGTTGGTTTGCTACCACATAAAGCCATGCTGTTTTTGGTCAAACTGTGTAA
ACTGGAAAAATTCACATCATTTCTGAGTTTAATCACTTTAGGATATATTCACATTGTTTTGGTGAATTTG
CTGAATTGAATTGTTTTCTTTCTCAAATCTGTGATCTCTTTTCTTTATCCTGTTTCTTTGTTCCTTTCG
TTTGCTTTCTTATTTTTCTTTTGTTCCATTCTTTTCTTACTTTTTTCCCTTTTCCTTTTTGGGGAGGCT
GGCTAGTAGTGTGTGAGAAAAGAATAGAAGTGAAATTTGCATAATGAATGTAAAAGGGAAATAAAAGTCT
TTTGAAGGTAGCTATACTAGCACTTTTGATCATCTTCAGGGCCCACAAAAATGTTGTCAAGATTTTAAAG
GTTTATAATTCTGCTTAAGCTCTAGTTTGGACTTAGGTATCCTAACTATGTTGGAGGTATTTGCATTGTT
TAAAGTTAGGATAAAAGCAAGTTCCTCCTGTGACTGCAACGTCTTACTGATTGGGACAGTTGCCAGGAGG
ATACCAACTTGATAGCAGAGGGGTTTTATGCAAACGCACTCACCTCCGCCTTGGGAATGAAAGGGTCA
CTTCTGCATCATCACTAGCTAGTTTTCTAGTGTTAGAGAGGCTTACAAATGTTTGCCATTCTCATAAGTG
TTTTGAACTTGATCTTTGTGACTTGTGCTTTTTAGCTTCTCTCTTGAATCAGAGTATCATTGTCTTCCT
CCAAGGAGTTAGAATTTCCAGTTTAAAACAAAAAGGGAAATGTCCTAGGTTTTCTTTGTGCTTCTCATT
TTTCCTTTGTTGATTCAATTCCTGTGATTTTTGTTCTCTTCCCTGAAGTGCTTTACAGTGCATGGAATCT
CCATCATTGTTATTTTAACGATAGTAATTCACAGTCCTCAGAAGCCTATTTTTAAAGCAGAAGCAAAAAA
```

Figure 20 (Continued)

```
GAAAAACAAAATAACAAAAACAACCCTTCCTCTTTTCTCTCATCTCACCTCTCTGTGTTGATTACTAATC
ATCTTAGATATTATTGCTAGTGGATGTATGGTAGATGGGTTGAAGCTTTTCTGATAATTATTACACAATT
TAAAACAACATATATATTTAAAATAAATATATACAGTAAATATATTGAGCCATGTTAACCTGCCAATGAG
ATCTGTGAAAAAATAATGGCCTCATTTTTCTCTTTTTAATTTCTTTTACCCTTTTGTGAAGCAGCTATAC
GTGGCATACATGTATTTAAAGAAAAAAAAATAGATGTAGAGTGTTTTTTTTACACTTTTAACTTAGCATG
TGGTGTTGAAGTATTACTGTAGATCAAGTTTGTCTTCCGCACTAAGATGTGAGGAAATTGTGATTTGTTC
TCTCCACCACAAATGAATTACACATTTATTATCTTCTATCATTTTGAAACACTGCAGTTTACCATGGGAC
ACTGTATATATTTCTTGCCATAATGGTAAAGGACTGATTGATATATTTAAGAGTTAATAAATTTGTGATT
TCTGCTGACAGTGCGTCCATCTTTATTTCTTCAGAAGAGGTACTGTATGTATGCCTGCATAGTGCTGGCC
AGTGTCAAGGGCAGTGTGTCCTACTCTGGTCTCATTTAGTACATAACAATTTGCACTTGGTGAGAATGGC
AAGTTAATTGTTCTCTGTGAGCAAAACAATGGTCTCTTCTGGGAAAATGTTGCTGAGAACAATATAGTTA
ACAACTAAGACTCCTAAAAGCTTCTCTAAACTGTACCCTCCAATCCAGCCTTCACATGGCTGCTTTTTTT
TTTTTTTTTTAATACGAACCTGTCCTTGTAACACTTTGATGTTATCATTTCTGGGATACAGGCAAGCACC
CCAGCTCCTGCTACTCCCCAGCTTGAACTTGAGCATACATGGATGCTCAGCTTCTTTTGATTTGCTAAAA
ACATCACACTTGCTCACATGCCTGTTTATGCTGTTCATGTTGTTTATGTTTCTTACCTAGAATAAATAGT
CTCTTCCCCTACTTCTTTTCCCGACTTCTTACTTTTTCCTAAGATTCAGTGTACAGCATCATGCTCCACA
GCAAACCTTCCTAGGCCCTATTCTGGGCTTGCCTTCCCTCTCAAAACCTACATAATAGATTGTATTTACC
TCTCCTGTCAACCACATTGTTTTGAAAATATATTTCTATTTGTGTCTCCTCTACTGCAGTATAATGTCTC
CATGGGCAAGAACTGTGTATTCATCATTGCATTCCTAAACCCAAACCAAGGCCAGGAATGGAGATATCAT
TGATAAATAGTTGTTGAATTGAGGCCAAGCCCTTTTGATAACAGAAGCCTCAAGGGGTACCCAGATAGTC
CTTGTTTTAATGATGGGTTCTCTCACCACTGTCTTGATGCTCTGAGCAAGTTACCTCTTCCCTCTGACCC
TCAGTTTCCATATTTGTAAAATGAGAATAAACATACCAACTTAATAAAGATATTGTGAGGATTAATGGGT
ACAGAGTGACTAGAATGATATTTGATAGAAATTAAATGGTAGCAGTATAACTATTCTGATCACTGACATT
AATATTCCTATTGTTATTATTCTTTGCTCACGAGGGTATACAACTCTTGTTTTGCTGTTGGGCTGCCCTC
TTTATGTAGGTTTACTGTTAATGCTGAGGATATACTCGGACTCAAATGTCTCAGCAGAAGGCTGAGAGAC
ACCAAATGAAGTGGTCATCTAGCTGAATGTAGGAAAAATGAAATGTAGTAGCAAATCAGTATATTCTAAG
GAAATTTTCAAGGAATATTAATCTTCACCCAAATTTTGAATTTTTATGTAAAAAATTATAATTTAAGGGT
AAACATAGATGACACAGCTTTCGAGTGATTTCATTGAATAAAATTCTACTGACTTCTATGAA

>gi|219842226|ref|NM_002005.3| Homo sapiens feline sarcoma oncogene (FES),
transcript variant 1, mRNA
GGAGGAAGCGCGGAATCAGGAACTGGCCGGGGTCCGCACCGGGCCTGAGTCGGTCCGAGGCCGTCCCAGG
AGCAGCTGCCCGTGCGGAACAGCACTATGGGCTTCTCTTCCGAGCTGTGCAGCCCCCAGGGCCACGGGGT
CCTGCAGCAAATGCAGGAGGCCGAGCTTCGTCTACTGGAGGGCATGAGAAAGTGGATGGCCCAGCGGGTC
AAGAGTGACAGGGAGTATGCAGGACTGCTTCACCACATGTCCCTGCAGGACAGTGGGGGCCAGAGCCGGG
CCATCAGCCCTGACAGCCCCATCAGTCAGTCCTGGGCTGAGATCACCAGCCAAACTGAGGGCCTGAGCCG
CTTGCTGCGGCAGCACGCAGAGGATCTGAACTCAGGGCCCCTGAGCAAGCTGAGCCTGCTCATCCGGGAA
CGGCAGCAGCTTCGCAAGACCTACAGCGAGCAGTGGCAGCAGCTGCAGCAGGAGCTCACCAAGACCCACA
GCCAGGACATTGAGAAGCTGAAGAGCCAGTACCGAGCTCTGGCACGGGACAGTGCCCAAGCCAAGCGCAA
GTACCAGGAGGCCAGCAAAGACAAGGACCGTGACAAGGCTAAGGACAAGTATGTGCGCAGCCTGTGGAAG
CTCTTTGCTCACCACAACCGCTATGTGCTGGGCGTGCGGGCTGCGCAGCTACACCACCAGCACCACCACC
AGCTCCTGCTGCCCGGCCTGCTGCGGTCACTGCAGGACCTGCACGAGGAGATGGCTTGCATCCTGAAGGA
```

Figure 20 (Continued)

```
GATCCTGCAGGAATACCTGGAGATTAGCAGCCTGGTGCAGGATGAGGTGGTGGCCATTCACCGGGAGATG
GCTGCAGCTGCTGCCCGCATCCAGCCTGAGGCTGAGTACCAAGGCTTCCTGCGACAGTATGGGTCCGCAC
CTGACGTCCCACCCTGTGTCACGTTCGATGAGTCACTGCTTGAGGAGGGTGAACCGCTGGAGCCTGGGGA
GCTCCAGCTGAACGAGCTGACTGTGGAGAGCGTGCAGCACACGCTGACCTCAGTGACAGATGAGCTGGCT
GTGGCCACCGAGATGGTGTTCAGGCGGCAGGAGATGGTTACGCAGCTGCAACAGGAGCTCCGGAATGAAG
AGGAGAACACCCACCCCGGGAGCGGGTGCAGCTGCTGGGCAAGAGGCAAGTGCTGCAAGAAGCACTGCA
GGGGCTGCAGGTAGCGCTGTGCAGCCAGGCCAAGCTGCAGGCCCAGCAGGAGTTGCTGCAGACCAAGCTG
GAGCACCTGGGCCCCGGCGAGCCCCCGCCTGTGCTGCTCCTGCAGGATGACCGCCACTCCACGTCGTCCT
CGGAGCAGGAGCGAGAGGGGGGAAGGACACCCACGCTGGAGATCCTTAAGAGCCACATCTCAGGAATCTT
CCGCCCCAAGTTCTCGCTCCCTCCACCGCTGCAGCTCATTCCGGAGGTGCAGAAGCCCCTGCATGAGCAG
CTGTGGTACCACGGGGCCATCCCGAGGGCAGAGGTGGCTGAGCTGCTGGTGCACTCTGGGGACTTCCTGG
TGCGGGAGAGCCAGGGCAAGCAGGAGTACGTGCTGTCGGTGCTGTGGGATGGTCTGCCCCGGCACTTCAT
CATCCAGTCCTTGGATAACCTGTACCGACTGGAAGGGGAAGGCTTTCCTAGCATTCCTTTGCTCATCGAC
CACCTACTGAGCACCCAGCAGCCCCTCACCAAGAAGAGTGGTGTTGTCCTGCACAGGGCTGTGCCCAAGG
ACAAGTGGGTGCTGAACCATGAGGACCTGGTGTTGGGTGAGCAGATTGGACGGGGGAACTTTGGCGAAGT
GTTCAGCGGACGCCTGCGAGCCGACAACACCCTGGTGGCGGTGAAGTCTTGTCGAGAGACGCTCCCACCT
GACCTCAAGGCCAAGTTTCTACAGGAAGCGAGGATCCTGAAGCAGTACAGCCACCCCAACATCGTGCGTC
TCATTGGTGTCTGCACCCAGAAGCAGCCCATCTACATCGTCATGGAGCTTGTGCAGGGGGCGACTTCCT
GACCTTCCTCCGCACGGAGGGGCCCGCCTGCGGGTGAAGACTCTGCTGCAGATGGTGGGGGATGCAGCT
GCTGGCATGGAGTACCTGGAGAGCAAGTGCTGCATCCACCGGGACCTGGCTGCTCGGAACTGCCTGGTGA
CAGAGAAGAATGTCCTGAAGATCAGTGACTTTGGGATGTCCCGAGAGGAAGCCGATGGGGTCTATGCAGC
CTCAGGGGGCCTCAGACAAGTCCCCGTGAAGTGGACCGCACCTGAGGCCCTTAACTACGGCCGCTACTCC
TCCGAAAGCGACGTGTGGAGCTTTGGCATCTTGCTCTGGGAGACCTTCAGCCTGGGGGCCTCCCCCTATC
CCAACCTCAGCAATCAGCAGACACGGGAGTTTGTGGAGAAGGGGGGCCGTCTGCCCTGCCCAGAGCTGTG
TCCTGATGCCGTGTTCAGGCTCATGGAGCAGTGCTGGGCCTATGAGCCTGGGCAGCGGCCCAGCTTCAGC
ACCATCTACCAGGAGCTGCAGAGCATCCGAAAGCGGCATCGGTGAGGCTGGGACCCCCTTCTCAAGCTGG
TGGCCTCTGCAGGCCTAGGTGCAGCTCCTCAGCGGCTCCAGCTCATATGCTGACAGCTCTTCACAGTCCT
GGACTCCTGCCACCAGCATCCACACTGCCGGCAGGATGCAGCGCCGTGTCCTCTCTGTGTCCCTGCTGCT
GCCAGGGCTTCCTCTTCCGGGCAGAAACAATAAAACCACTTGTGCCCACTGAA

>gi|4505304|ref|NM_002477.1| Homo sapiens myosin, light chain 5, regulatory
(MYL5), mRNA
GGAGTGGCAGCCGGAGTCTGAACTGTCCTGGGGGACCAAGCAGGAGCTTAAGATGGGCAAGACCTGGGGC
CCTGGGCAGACGCATCAAAGCAGGCAGAAGCAGGCATGGCCAGCAGGAAGACCAAGAAGAAGGAAGGGGG
TGCCCTCCGGGCCCAGAGAGCCTCATCCAATGTCTTCTCCAACTTTGAGCAGACTCAGATCCAGGAGTTC
AAGGAGGCATTCACACTCATGGATCAGAACCGAGATGGCTTCATTGACAAGGAGGACCTGAAGGACACCT
ATGCCTCCCTGGGCAAGACCAACGTCAAGGACGACGAGCTGGACGCCATGCTCAAAGAGGCCTCGGGGCC
CATCAACTTCACCATGTTTCTGAACCTGTTTGGGGAGAAGCTGAGCGGTACCGACGCCGAGGAGACCATT
CTTAACGCCTTCAAGATGCTGGACCCGGACGGGAAAGGGAAAATCAACAAGGAGTACATCAAGCGTCTGC
TGATGTCCCAGGCTGACAAGATGACGGCGGAAGAGGTGGACCAGATGTTCCAGTTCGCCTCCATCGATGT
GGCGGGCAACCTGGACTACAAGGCGCTCAGCTACGTGATCACCCACGGGGAGGAGAAGGAGGAGTGAGAC
CCAGCCGGGTCAATAAACCTGGACGCTTGGA
```

Figure 20 (Continued)

>gi|316659406|ref|NM_002489.3| Homo sapiens NADH dehydrogenase (ubiquinone) 1
alpha subcomplex, 4, 9kDa (NDUFA4), nuclear gene encoding mitochondrial protein,
mRNA
GGGTCCTTCAGGTAGGAGGTCCTGGGTGACTTTGGAAGTCCGTAGTGTCTCATTGCAGATAATTTTAGC
TTAGGGCCTGGTGGCTAGGTCGGTTCTCTCCTTTCCAGTCGGAGACCTCTGCCGCAAACATGCTCCGCCA
GATCATCGGTCAGGCCAAGAAGCATCCGAGCTTGATCCCCCTCTTTGTATTTATTGGAACTGGAGCTACT
GGAGCAACACTGTATCTCTTGCGTCTGGCATTGTTCAATCCAGATGTTTGTTGGGACAGAAATAACCCAG
AGCCCTGGAACAAACTGGGTCCCAATGATCAATACAAGTTCTACTCAGTGAATGTGGATTACAGCAAGCT
GAAGAAGGAACGTCCAGATTTCTAAATGAAATGTTTCACTATAACGCTGCTTTAGAATGAAGGTCTTCCA
GAAGCCACATCCGCACAATTTTCCACTTAACCAGGAAATATTTCTCCTCTAAATGCATGAAATCATGTTG
GAGATCTCTATTGTAATCTCTATTGGAGATTACAATGATTAAATCAATAAATAACTGAAACTTGATATGT
GTCACTTTTTTATGCTGAAAGTATGCTCTGAACTTTAGAGTATAGGAAATTAACTATTAGAATTTAAAGA
ATTTCTTGAATTTCTGTAGTTTGAAAATACGACTTTAAGCTGCTTTAGTAAAACACTTCCATTTTGTGTA
TAGACTGTTGGTAACTTCACTAGAGCATACATAACAACTGGAACTGGAAATTATACAAAAGTAAATTGGG
AAGGATACTCCAGCATCTGACACTGGCAAAATGGAAACCTTTGAGTTTCTCTTACTGGCTGTTGAAGTGT
GTGCAGTTTTTAACAATGGTTTTTACTTGGCATCTCTTTGTTGTGATTTTCAAGGTTATAAGTTGCTTTG
GTCCTAGGATTGAAGTTGAAATCTGAGTTTATCAGTGCTAACCATGGTGCTAGTAGTCAAGAGATCTTGA
GAATTTTGGCTGCTGAGTCTTGGTGCAGGGTGCAGGTTTTCTTTTCTTTTTCTTTTTTTTTTTTGAG
ATAGTCTCTGTCACCCAGGCTGGAGTGCAGTGGTACAAACATGGATCACTGCAGCCTCTACCTCCCGGGC
TTAAGTGATCCTCCTGCCTCAGCCCTAAGTAGCCGGGACTACAGGTATGTGCCACCATGCCCAGTTAAT
TTTTGTAATTTTTTTAGAGACAGGGTTTTGCCATGTTGCCCAGGCTGGTCTCAAACTCTTGAGCTCAAG
CGATCCATTCTCCTCAGCCTCCCAGGGTGCTGGGATTACAGGCGTGAGCCATTGCGCTTAGCCATGGTGC
AGGTTTTCAAAGGCCAGGAAGTATATTCATAATTTTAAGATGGGGAATATAGCAAGTTTTCACATAGGTG
TGTGTAAGTCATCACATCATAGAAACTTGAGGAATTCAGTGACATTAATTTTGGATTTTCATACGTAAGT
ATACAATTAAATGTTTACAGGGTAGTAGAAGCACATTTTAAATGTCAGGAACTGAACTAAGTATTTGAAT
TACGTGGATTATCTCAAAAATTTTGAAATTGTTAAACGAGTTGAATTACTTGAATTCATTCTGTTAGTCA
AATGGTGGATATTTACACCCATGTAGTTTTGAATTTAGAGTGTGTAGAGTGTTTTCAGTTACCAGACTCC
ATGCTTTTACCTCCTATGTGTCAGGTATAATTTGAACCTCTAAGAACAGGGTTTCTCAACCTTGCCACTG
TTGACTATTCTGAAAGACAGTTTGGTTTAGCAGACCATCCCATGCGCTTTAGCTTGTTTAGTAGCTAAC
TTGGGCTCTGCCACTACAGACAAAAAGCACTCTTTCCCTCCAATTCCCACAGGCTATGAGAAGAATGGAG
ACATTACCAAATGTCCATTGGTGGGCAAAATTGCTTCATTCCTACCTCTGTTGAGAATTACTCTAGATCC
TTTGGCACAAATTACCTCAAAGTTTAAAATTGTGTAAACAAACAGTGTGTCATGTAATTGAAAAACATTA
AGCAACTCCAAATAAATGCTACATTAAG >gi|32307160|ref|NM_003592.2| Homo sapiens cullin 1 (CUL1), mRNA
AGGAGGAGGGCCGGGCGGGCAGGGAGGAGGAGGAGGCGGGCGCCGTGTCGCACGCAGCTCCAGGCGGGG
CAGCCCCGGTAGCTGAGGGACGCAGCTAGACCTTGGCGGGACGGGGCTTTCGCCGGGGCCCAGGCCCAGG
GACCAGGCGGAGGCGTCGCGGGAGCCTTTGGGGCACCACAGAGATGCGGGTTTGCCTGCAATGAGATTTC
ATTCTCTACATTTAAAGGACATCCTTTCTGAGCTGCTGTGAATAAATTTGGAATGGTACTGTATATTTTC
ATCTAATGGAGAACTAGCTGTACTTTGAATAAGGATTGCTGCACTGGACGACTTTAGAACATCCCTCACA
ATGTCGTCAACCCGGAGCCAGAACCCCCACGGCCTGAAGCAGATTGGCCTGGACCAGATCTGGGACGACC Figure 20 (Continued)

```
TCAGAGCCGGCATCCAGCAGGTGTACACACGGCAGAGCATGGCCAAGTCCAGATATATGGAGCTCTACAC
TCATGTTTATAACTACTGTACTAGTGTTCACCAGTCAAACCAAGCACGAGGAGCTGGAGTTCCTCCTTCT
AAGTCGAAAAAGGGGCAGACACCTGGAGGAGCTCAGTTTGTTGGCCTGGAATTATATAAACGACTTAAGG
AATTTTTGAAGAATTACTTGACAAATCTTCTTAAGGATGGAGAAGATTTGATGGATGAGAGTGTACTGAA
ATTCTACACTCAACAATGGGAAGATTATCGATTTTCAAGCAAAGTGCTGAATGGAATTTGTGCCTACCTC
AATAGACATTGGGTTCGCCGTGAATGTGACGAAGGACGAAAAGGAATATATGAAATCTATTCGCTTGCAT
TGGTGACTTGGAGAGACTGTCTGTTCAGGCCACTGAATAAACAGGTAACAAATGCTGTTTTAAAGCTGAT
TGAAAAGGAAAGGAATGGTGAAACCATCAATACAAGATTGATTAGTGGAGTTGTACAGTCTTACGTGGAA
TTGGGGCTGAATGAAGATGATGCATTTGCAAAGGGCCCTACGTTAACAGTGTATAAAGAATCCTTTGAAT
CTCAATTTTTGGCTGACACAGAGAGATTTTATACCAGAGAGAGTACTGAATTCTTGCAGCAGAACCCAGT
TACTGAATATATGAAAAAGGCAGAGGCTCGTCTGCTTGAGGAACAACGAAGAGTTCAGGTTTACCTTCAT
GAAAGCACACAAGATGAATTAGCAAGGAAATGTGAACAAGTCCTCATTGAAAAACACTTGGAAATTTTCC
ACACAGAATTTCAGAATTTATTGGATGCTGACAAAAATGAAGATTTGGGACGCATGTATAATCTTGTATC
TAGAATCCAGGATGGCCTAGGAGAATTGAAAAAACTGTTGGAGACACACATTCATAATCAGGGTCTTGCA
GCCATTGAAAAGTGTGGAGAAGCTGCTTTAAATGACCCCAAAATGTATGTACAGACAGTGCTTGATGTTC
ATAAAAAATACAATGCCCTGGTAATGTCTGCATTCAACAATGACGCTGGCTTTGTGGCTGCTCTTGATAA
GGCTTGTGGTCGCTTCATAAACAACAACGCGGTTACCAAGATGGCCCAATCATCCAGTAAATCCCCTGAG
TTGCTGGCTCGATACTGTGACTCCTTGTTGAAGAAAAGTTCCAAGAACCCAGAGGAGGCAGAACTAGAAG
ACACACTCAATCAAGTGATGGTTGTCTTCAAGTACATAGAAGACAAAGACGTATTTCAGAAGTTCTATGC
GAAGATGCTCGCCAAGAGGCTCGTCCACCAGAACAGTGCAAGTGACGATGCCGAAGCCAGCATGATCTCC
AAGTTAAAGCAAGCTTGCGGGTTCGAGTACACCTCTAAACTTCAGCGCATGTTTCAAGACATTGGCGTGA
GCAAAGATCTGAACGAGCAATTCAAAAAGCACTTGACAAACTCAGAACCCCTAGACTTGGATTTCAGCAT
TCAAGTGCTGAGCTCCGGGTCCTGGCCCTTCCAGCAGTCTTGTACATTTGCCTTGCCGTCAGAGTTGGAA
CGTAGTTATCAGCGATTCACAGCTTTCTACGCCAGCCGCCACAGTGGCCGAAAATTGACGTGGTTATATC
AGTTGTCTAAAGGAGAATTGGTAACTAACTGCTTCAAAAACAGATATACTTTGCAGGCGTCGACATTCCA
GATGGCTATCCTGCTTCAGTACAACACGGAAGATGCCTACACTGTGCAGCAGCTGACCGACAGCACTCAA
ATTAAAATGGACATTTTGGCGCAAGTTTTACAGATTTTATTAAAGTCGAAGCTATTGGTCTTGGAAGATG
AAAATGCAAATGTTGATGAGGTGGAATTGAAGCCAGATACCTTAATAAAATTATATCTTGGTTATAAAAA
TAAGAAATTAAGGGTTAACATCAATGTGCCAATGAAAACCGAACAGAAGCAGGAACAAGAAACCACACAC
AAAAACATCGAGGAAGACCGCAAACTACTGATTCAGGCGGCCATCGTGAGAATCATGAAGATGAGGAAGG
TTCTGAAACACCAGCAGTTACTTGGCGAGGTCCTCACTCAGCTGTCCTCCAGGTTCAAACCTCGAGTCCC
TGTGATCAAGAAATGCATTGACATTCTAATTGAGAAAGAATATTTGGAGCGAGTGGATGGTGAAAAGGAC
ACCTACAGTTACTTGGCTTAACCCTTCTGGAAGGGTCTGACTGTGTGACCCGCAGCAAATAGTTCATGTT
GGAAAGAATGAAAACAACTCAAGTTCATAGCAGCCAGCCTGCCGCCATTGGACCTCCCTTTTAAAAACTG
AGACCAAGACTCCCATCAGCTGGTCTCGGATTTACATCGGAACTGCTCAGGATTGATACATTTCAAGTCT
GTAAATACGGACACCAACGCCATTTACCCTAATTTAAGAACAGCGGGGACTGACCCTCCGTGCCGAGGGC
TGCATGCTACCGCACTAAGTCAATACATGGGCTCCCCGATTCGCAGCTGTCGTCTTGGCAGCACTTGTCA
CGTTGGCAGCACTTTGAGAGCAAGTCTGAGTGGACCCACATGTAACCTGCTATGAAAACCATTTGTATAG
TGTGTTTCATTTTTTAATGTGTGAAAATAAAGAAAATTAAAGGATTTCTGTACAAGTCGCATTGGGTTTT
GTTTTAAGTTTTACTAATTTCTATATGTAAATAAAAGATATAATGATTGTGCAAATTTAAAAAAAAAAAA
AAAAAA
```

Figure 20 (Continued)

>gi|148922910|ref|NM_004148.3| Homo sapiens ninjurin 1 (NINJ1), mRNA
CGCAGCTGGAGCCTGCGGCTGAGGCTCGGGCGCGCTCAGGCCCGGATCCTGGCGGCCTGGGCGGCCGCAC
CATGGACTCGGGAACCGAGGAGTACGAGCTCAACGGCGGCCTGCCTCCGGGCACACCCGGCTCCCCGGAC
GCCTCGCCGGCCCGCTGGGGCTGGAGGCACGGGCCCATCAACGTGAACCATTACGCCAGCAAGAAGAGCG
CAGCCGAGAGCATGCTGGACATCGCGCTGCTGATGGCCAACGCGTCCCAGCTGAAGGCCGTCGTGGAACA
GGGCCCCAGCTTCGCCTTCTATGTGCCCCTGGTGGTCCTCATCTCCATCTCCCTTGTGCTGCAGATCGGC
GTGGGGGTGCTGCTCATCTTCCTTGTCAAGTACGACCTTAACAACCCGGCCAAGCACGCCAAGCTGGACT
TCCTCAACAACCTGGCCACGGGCCTGGTGTTCATCATCGTGGTAGTCAACATCTTCATCACGGCCTTCGG
GGTCCAGAAGCCCTTGATGGACATGGCACCCAGCAGTAGGACACCCAGGACCCTGGATGCTGCCTGCCC
TGCAACTCAGCTGCCCGACCCCAGGAGTCGCCATACCTGTGAGGTGTCCACCTCCCTGCACATGGCACTA
CCCAGACTGCCAGAGCCCAGGCTGGCCTCATCTGCACCATGTCCCCGGACCAGCCCTTGCTCTGACTGCG
GCCAAGCACCACGCAGGAGGCCACTCTTGTCTCTCAGCAGCTGTTCCCAGGAGGCAGCTCCCTCCTGGCA
CATGGGGGCTGGCCACAATAGCCCAGAGGGTCAGAACTGGACAGCTGCAGAGACCTGTGCCCAGAGAAGG
GTCTCGACCCACTCAAGGACACACAGCAGGTCCGTGGATGGGCTGGATGAGTGACCAGGGCCAGCCTCTG
TCTCAGGACATTCCAGAAGGACAAGGAGATGTCTCTCCCTCTCCCAAAGCACCAGCGTCCCTGCCTCCCG
TGGGCCCTGTCCGGGTTGCCCTGGTGACCCCAGCCTCTGTCCACTTCCTAACCCAGGGACCCTGCACAGC
CAGAACTGCCTTTGGCCCTACGGATGGCCACTGGCTCTGGTCTTAAGTGCCTGGGCTTGGTGGCCATCAA
GAGGGAGCCAGTCAGGCCTGTGAGGGCCGTAGACCTTGTATATACCCTGCACCAGCAGTGACCGGGCAGA
GCCCAACCCCCTCCACGGGGGTCCCAGCACCCACTTTTCTAATCATGAATGAACAATAAAGCCCACGCTC
TTTGTCAGGCTCCACATGCCAAAAAAAAAAAAAAAAAA >gi|41349436|ref|NM_004329.2| Homo sapiens bone morphogenetic protein receptor,
type IA (BMPR1A), mRNA
GCGGCCGCTGCAGAGATTGGAATCCGCCTGCCGGGCTTGGCGAAGGAGAAGGGAGGAGGCAGGAGCGAGG
AGGGAGGAGGGCCAAGGGCGGGCAGGAAGGCTTAGGCTCGGCGCGTCCGTCCGCGCGCGGCGAAGATCGC
ACGGCCCGATCGAGGGGCGACCGGGTCGGGGCCGCTGCACGCCAAGGGCGAAGGCCGATTCGGGCCCCAC
TTCGCCCCGGCGGCTCGCCGCGCCCACCCGCTCCGCGCCGAGGGCTGGAGGATGCGTTCCCTGGGGTCCG
GACTTATGAAAATATGCATCAGTTTAATACTGTCTTGGAATTCATGAGATGGAAGCATAGGTCAAAGCTG
TTTGGAGAAAATCAGAAGTACAGTTTTATCTAGCCACATCTTGGAGGAGTCGTAAGAAAGCAGTGGGAGT
TGAAGTCATTGTCAAGTGCTTGCGATCTTTTACAAGAAAATCTCACTGAATGATAGTCATTTAAATTGGT
GAAGTAGCAAGACCAATTATTAAAGGTGACAGTACACAGGAAACATTACAATTGAACAATGCCTCAGCTA
TACATTTACATCAGATTATTGGGAGCCTATTTGTTCATCATTTCTCGTGTTCAAGGACAGAATCTGGATA
GTATGCTTCATGGCACTGGGATGAAATCAGACTCCGACCAGAAAAAGTCAGAAAATGGAGTAACCTTAGC
ACCAGAGGATACCTTGCCTTTTTTAAAGTGCTATTGCTCAGGGCACTGTCCAGATGATGCTATTAATAAC
ACATGCATAACTAATGGACATTGCTTTGCCATCATAGAAGAAGATGACCAGGGAGAAACCACATTAGCTT
CAGGGTGTATGAAATATGAAGGATCTGATTTTCAGTGCAAAGATTCTCCAAAAGCCCAGCTACGCCGGAC
AATAGAATGTTGTCGGACCAATTTATGTAACCAGTATTTGCAACCCACACTGCCCCCTGTTGTCATAGGT
CCGTTTTTTGATGGCAGCATTCGATGGCTGGTTTTGCTCATTTCTATGGCTGTCTGCATAATTGCTATGA
TCATCTTCTCCAGCTGCTTTTGTTACAAACATTATTGCAAGAGCATCTCAAGCAGACGTCGTTACAATCG
TGATTTGGAACAGGATGAAGCATTTATTCCAGTTGGAGAATCACTAAAAGACCTTATTGACCAGTCACAA
AGTTCTGGTAGTGGGTCTGGACTACCTTTATTGGTTCAGCGAACTATTGCCAAACAGATTCAGATGGTCC
GGCAAGTTGGTAAAGGCCGATATGGAGAAGTATGGATGGGCAAATGGCGTGGCGAAAAAGTGGCGGTGAA Figure 20 (Continued)

```
AGTATTCTTTACCACTGAAGAAGCCAGCTGGTTTCGAGAAACAGAAATCTACCAAACTGTGCTAATGCGC
CATGAAAACATACTTGGTTTCATAGCGGCAGACATTAAAGGTACAGGTTCCTGGACTCAGCTCTATTTGA
TTACTGATTACCATGAAATGGATCTCTCTATGACTTCCTGAAATGTGCTACACTGGACACCAGAGCCCT
GCTTAAATTGGCTTATTCAGCTGCCTGTGGTCTGTGCCACCTGCACACAGAAATTTATGGCACCCAAGGA
AAGCCCGCAATTGCTCATCGAGACCTAAAGAGCAAAAACATCCTCATCAAGAAAAATGGGAGTTGCTGCA
TTGCTGACCTGGGCCTTGCTGTTAAATTCAACAGTGACACAAATGAAGTTGATGTGCCCTTGAATACCAG
GGTGGGCACCAAACGCTACATGGCTCCCGAAGTGCTGGACGAAAGCCTGAACAAAAACCACTTCCAGCCC
TACATCATGGCTGACATCTACAGCTTCGGCCTAATCATTTGGGAGATGGCTCGTCGTTGTATCACAGGAG
GGATCGTGGAAGAATACCAATTGCCATATTACAACATGGTACCGAGTGATCCGTCATACGAAGATATGCG
TGAGGTTGTGTGTGTCAAACGTTTGCGGCCAATTGTGTCTAATCGGTGGAACAGTGATGAATGTCTACGA
GCAGTTTTGAAGCTAATGTCAGAATGCTGGGCCCACAATCCAGCCTCCAGACTCACAGCATTGAGAATTA
AGAAGACGCTTGCCAAGATGGTTGAATCCCAAGATGTAAAAATCTGATGGTTAAACCATCGGAGGAGAAA
CTCTAGACTGCAAGAACTGTTTTTACCCATGGCATGGGTGGAATTAGAGTGGAATAAGGATGTTAACTTG
GTTCTCAGACTCTTTCTTCACTACGTGTTCACAGGCTGCTAATATTAAACCTTTCAGTACTCTTATTAGG
ATACAAGCTGGGAACTTCTAAACACTTCATTCTTTATATATGGACAGCTTTATTTTAAATGTGGTTTTTG
ATGCCTTTTTTTAAGTGGGTTTTTATGAACTGCATCAAGACTTCAATCCTGATTAGTGTCTCCAGTCAAG
CTCTGGGTACTGAATTGCCTGTTCATAAAACGGTGCTTTCTGTGAAAGCCTTAAGAAGATAAATGAGCGC
AGCAGAGATGGAGAAATAGACTTTGCCTTTTACCTGAGACATTCAGTTCGTTTGTATTCTACCTTTGTAA
AACAGCCTATAGATGATGATGTGTTTGGGATACTGCTTATTTATGATAGTTTGTCCTGTGTCCTTAGTG
ATGTGTGTGTCTCCATGCACATGCACGCCGGGATTCCTCTGCTGCCATTTGAATTAGAAGAAAATAAT
TTATATGCATGCACAGGAAGATATTGGTGGCCGGTGGTTTTGTGCTTTAAAAATGCAATATCTGACCAAG
ATTCGCCAATCTCATACAAGCCATTTACTTTGCAAGTGAGATAGCTTCCCCACCAGCTTTATTTTTAAC
ATGAAAGCTGATGCCAAGGCCAAAAGAAGTTTAAAGCATCTGTAAATTTGGACTGTTTTCCTTCAACCAC
CATTTTTTTGTGGTTATTATTTTTGTCACGGAAAGCATCCTCTCCAAAGTTGGAGCTTCTATTGCCATG
AACCATGCTTACAAAGAAAGCACTTCTTATTGAAGTGAATTCCTGCATTTGATAGCAATGTAAGTGCCTA
TAACCATGTTCTATATTCTTTATTCTCAGTAACTTTTAAAAGGGAAGTTATTTATATTTTGTGTATAATG
TGCTTTATTTGCAAATCACCCACTCCTTTACAACCATACTTTATATATGTACATACATTCATACTGTAGA
AACCAGCTCATGTGTACCTCATATCCCATCCTTAAGAGAAGAAATGTTATAAAGTAGAACTAAATATAAA
TTTTCAGAATTAATGCATTCAAAGTAATATATCAAATCCAGGACTTTGTTAACTTCAGGTAAAAACTTCA
TTAGGGTAATATCATCTCAATTTTTTCAAATGAAAGGATTCTCTAATTAGAAATTTATATGTCAGAGCTG
TTATAAATTTATCAACTGTCAAATATGTTCTGGACAGCTAAATCATTTGAGATTTTTGGTTTTTTGATTT
CTATTCCCTAACTTGTGAAGACAATGAAAAATCAGGCAGAAATATTTAGTATCTAGTCAGTATCTGTAGC
TACACTGTATAACTGTTCTTCAATAAAATGGTTCATATTTTATAGAAAAAAAAAAAAAAAA

>gi|342837718|ref|NM_004724.3| Homo sapiens ZW10, kinetochore associated, homolog
(Drosophila) (ZW10), mRNA
GTTTCCCGGCAGGCCTCGCGTCAAGACGGCCGGCGGGACGGGAGCTGCGGCGCTGGCTACGAGAGTGACC
CAGTCAGCGTTGGTTCCCGTCTTGGCCATGGCCTCGTTCGTGACAGAAGTTTTGGCACACTCCGGGAGGC
TGGAAAAGGAGGATCTGGGGACCCGGATCAGCCGCCTGACCCGGCGGGTGGAGGAGATCAAGGGTGAGGT
GTGCAATATGATTAGCAAGAAGTACAGTGAATTCCTGCCTAGCATGCAGAGCGCGCAGGGCCTGATTACC
CAGGTGGATAAGCTATCTGAAGACATTGACCTGCTGAAATCCAGGATAGAGAGTGAGGTCCGCCGGGATC
TTCACGTATCAACCGGTGAATTTACAGACTTAAAGCAGCAGTTGGAAAGAGACTCAGTTGTCCTAAGTTT
```

Figure 20 (Continued)

```
GCTTAAACAGTTGCAGGAGTTTTCCACTGCTATTGAAGAATATAATTGTGCATTAACAGAGAAGAAGTAT
GTCACTGGTGCTCAGCGTCTGGAAGAGGCACAGAAATGCTTGAAGTTATTAAAATCCAGAAAATGCTTTG
ATTTAAAAATATTGAAATCTCTCAGCATGGAGCTCACAATACAGAAACAGAACATACTTTATCACCTTGG
AGAAGAGTGGCAGAAGCTGATTGTATGGAAGTTCCCACCATCAAAAGATACCAGCAGTTTGGAATCTTAC
CTACAAACTGAACTTCATTTATACACTGAACAATCGCACAAAGAGGAGAAGACCCCTATGCCACCCATCA
GTTCTGTCCTCTTGGCATTTTCTGTTCTTGGAGAACTACACAGCAAGCTTAAATCATTTGGTCAGATGCT
GCTGAAGTATATCCTTAGGCCGCTGGCATCTTGCCCATCCCTTCATGCTGTGATAGAAAGCCAGCCTAAC
ATAGTTATTATTCGTTTTGAATCTATAATGACTAACTTGGAATATCCATCACCATCTGAAGTTTTTACAA
AGATCAGACTGGTACTAGAAGTGCTCCAGAAACAGCTTCTAGATTTGCCACTTGACACTGACCTGGAAAA
TGAAAAAACATCTACTGTCCCATTGGCTGAGATGCTTGGAGACATGATCTGGGAGGACTTGTCTGAGTGC
CTCATCAAAAACTGTTTGGTTTATTCGATTCCAACAAATAGCAGCAAATTACAGCAATATGAAGAGATCA
TACAGTCCACTGAAGAATTTGAAAATGCCCTAAAGGAAATGAGATTTTTAAAAGGAGATACTACAGATTT
GCTGAAATACGCTCGTAACATCAATTCTCATTTTGCAAACAAAAAGTGCCAGGATGTGATTGTGGCAGCC
AGAAATCTAATGACCTCAGAAATTCATAACACTGTGAAGATTATTCCTGATTCTAAGATAAATGTGCCAG
AGTTACCCACTCCTGATGAGGATAACAAACTGGAAGTACAGAAAGTATCCAATACTCAGTACCACGAAGT
GATGAATTTAGAGCCTGAAAATACATTGGACCAACATTCCTTTTCCTTGCCCACATGCCGTATCAGTGAG
TCTGTGAAGAAATTAATGGAACTCGCCTATCAGACTTTACTAGAGGCAACAACCAGTAGTGATCAATGTG
CTGTTCAACTTTTCTACTCAGTGAGGAATATCTTCCATTTGTTCCATGATGTTGTACCAACATATCACAA
GGAGAACCTTCAAAAACTTCCCCAGTTGGCTGCTATTCATCACAACAACTGTATGTACATTGCTCACCAC
TTGCTGACCCTCGGGCATCAGTTCAGATTGCGTCTTGCCCCCATTCTTTGTGATGGCACTGCTACTTTTG
TGGATCTTGTACCTGGCTTCAGGAGACTTGGGACAGAATGCTTTTTGGCCCAAATGCGGGCACAGAAAGG
TGAACTTCTGGAAAGATTATCAAGTGCTAGGAACTTTTCAAATATGGACGATGAAGAGAATTATTCTGCA
GCAAGTAAAGCAGTCCGGCAGGTACTGCACCAACTAAAGAGACTTGGAATTGTGTGGCAGGATGTCCTGC
CAGTGAATATATATTGCAAGGCTATGGGGACTTTACTCAATACAGCAATTTCTGAGGTCATTGGCAAAAT
TACTGCCCTAGAGGACATATCTACTGAAGATGGTGATAGGTTATATTCCTTATGCAAAACAGTGATGGAT
GAAGGACCCCAAGTATTTGCACCTTTATCTGAAGAAAGCAAGAACAAGAAATATCAAGAAGAGGTTCCAG
TCTATGTGCCAAAATGGATGCCATTCAAGGAATTGATGATGATGCTACAAGCCAGCTTGCAAGAAATTGG
GGATCGGTGGGCAGATGGAAAAGGACCCCTGGCAGCTGCGTTCTCTTCCAGTGAAGTAAAAGCTTTAATT
CGTGCCTTGTTTCAGAACACAGAAAGAAGAGCAGCTGCCCTTGCTAAAATTAAATAGCTCCATCTTCTTA
AGAAAGCTATGTCTTGAATATGTGGATTCTTCCCTTGGCATAATTACTCCCTTAAAGACTTCTTTGAATC
GCCCATTGGTTTTGGTGAACCAGTACATCTTGGAAGTTTGACTTTACAGAAGAACGTCTTACCTCCTGGC
CTGTACGAGGCTTTGTTTAAGAACTGTTTATTAAGATAAATTGTCAAGTAAAGCACCTCAATTCATTGAC
TTTCTAGCCATCTTCCTTTGATTAGCTAACAAACTGTCAGGCAGCATTATTTCATGCTGCTTCCAGAGCC
CTCTGGGAGCTATATACATTGTAAATGCAGGCCCTAGCTTTGGAACGAGGAATTGGGAGATTCCAGGAGT
CAGGGTAGAGAATTTCTGAGCAAATCGGAGATATTTTAGGGGTGTGGAGGAGGGAAGGGAGGAATGGGC
CACCATATTTGGCCTTACAGGAATTAAGGAGACTTCCTGTAATATTTCTTTCCAATAAATATTGCTTTTT
ACAATTAAAAAAAAAAAAAAAAAA

>gi|269847767|ref|NM_005158.4| Homo sapiens v-abl Abelson murine leukemia viral
oncogene homolog 2 (ABL2), transcript variant c, mRNA
CTCTTTACACAGAACAGTTTAACTTTTGTGCTTCTGGGCAGAGGTATGGTCCTTGGGACAGTTCTCCTTC
CACCTAATAGTTATGGCAGAGATCAGGACACTTCACTTTGCTGCCTGTGCACTGAGGCCTCAGAATCTGC
```

Figure 20 (Continued)

```
TCTACCCGACTTAACAGATCACTTTGCCAGCTGTGTGGAGGATGGATTTGAGGGAGACAAGACTGGAGGC
AGTAGTCCAGAAGCTTTGCATCGTCCCTATGGTTGTGATGTTGAACCCCAGGCACTAAATGAGGCTATCA
GGTGGAGCTCCAAGGAGAACTTGCTCGGAGCCACTGAGAGTGACCCTAATCTCTTCGTTGCACTTTATGA
TTTTGTAGCAAGTGGTGATAACACACTCAGCATCACTAAAGGTGAAAAGCTACGAGTCCTTGGTTACAAC
CAGAATGGTGAGTGGAGTGAAGTTCGCTCTAAGAATGGGCAGGGCTGGGTGCCAAGCAACTACATCACCC
CAGTGAACAGCCTGGAAAAACACTCCTGGTACCATGGACCTGTGTCACGCAGTGCAGCTGAGTATCTGCT
CAGCAGTCTAATCAATGGCAGCTTCCTGGTGCGAGAAAGTGAGAGTAGCCCTGGGCAGCTGTCCATCTCG
CTCAGGTACGAGGGACGTGTGTATCACTACAGGATCAATACCACTGCAGATGGCAAGGTGTATGTGACTG
CTGAGAGCCGCTTCAGCACCTTGGCAGAGCTTGTACACCATCACTCCACAGTGGCTGATGGGCTGGTGAC
AACATTACACTACCCAGCACCCAAGTGTAATAAGCCTACAGTCTATGGTGTGTCCCCCATCCACGACAAA
TGGGAAATGGAGCGAACAGATATTACCATGAAGCACAAACTTGGGGCGGTCAGTATGGAGAGGTTTACG
TTGGCGTCTGGAAGAAATACAGCCTTACAGTTGCTGTGAAAACATTGAAGGAAGATACCATGGAGGTAGA
AGAATTCCTGAAAGAAGCTGCAGTAATGAAGGAAATCAAGCATCCTAATCTGGTACAACTTTTAGGTGTG
TGTACTTTGGAGCCACCATTTTACATTGTGACTGAATACATGCCATACGGGAATTTGCTGGATTACCTCC
GAGAATGCAACCGAGAAGAGGTGACTGCAGTTGTGCTGCTCTACATGGCCACTCAGATTTCTTCTGCAAT
GGAGTACTTAGAGAAGAAGAATTTCATCCATAGAGATCTTGCAGCTCGTAACTGCCTAGTGGGAGAAAAC
CATGTGGTAAAAGTGGCTGACTTTGGCTTAAGTAGATTGATGACTGGAGACACTTATACTGCTCATGCTG
GAGCCAAATTTCCTATTAAGTGGACAGCACCAGAGAGTCTTGCCTACAATACCTTCTCAATTAAATCTGA
CGTCTGGGCTTTTGGGGTATTGTTGTGGGAAATTGCTACCTATGGAATGTCACCATATCCAGGTATTGAC
CTGTCTCAGGTCTATGACCTACTAGAAAAAGGATATCGAATGGAACAGCCTGAGGGATGCCCCCCTAAGG
TTTATGAACTTATGAGAGCATGCTGGAAGTGGAGCCCTGCCGATAGGCCCTCTTTTGCTGAAACACACCA
AGCTTTTGAAACCATGTTCCATGACTCCAGCATTTCTGAAGAGGTAGCTGAGGAGCTTGGAGAGCCGCC
TCCTCGTCATCTGTTGTTCCATACCTGCCCCGGCTACCTATACTTCCTTCCAAGACTCGGACACTGAAGA
AACAGGTGGAGAACAAGGAGAACATTGAAGGGGCACAAGATGCCACAGAAAATTCTGCTTCCAGTTTAGC
ACCAGGGTTCATCAGAGGTGCACAGGCCTCTAGTGGATCCCCAGCACTGCCTCGAAAGCAAAGAGACAAG
TCACCCAGCAGCCTCTTGGAAGATGCCAAAGAGACATGCTTCACCAGGGATAGGAAGGGGGGCTTCTTCA
GCTCCTTCATGAAGAAGAGAAATGCTCCTACACCCCCAAACGCAGCAGCTCCTTCCGAGAAATGGAGAA
TCAGCCCCATAAGAAATACGAACTCACGGGTAACTTCTCATCTGTTGCTTCTCTACAGCATGCTGATGGG
TTCTCTTTCACTCCTGCCCAGCAAGAGGCGAATCTGGTGCCACCCAAGTGCTATGGGGGGAGCTTTGCAC
AGAGGAACCTCTGTAATGACGACGGTGGTGGGGGTGGGGCAGTGGCACTGCTGGGGGTGGGTGGTCTGG
CATCACAGGCTTCTTTACACCACGCTTAATCAAAAAGACACTGGGCTTACGAGCAGGTAAACCCACAGCC
AGTGATGACACTTCCAAGCCTTTTCCAAGGTCAAACTCTACATCTTCCATGTCCTCAGGGCTTCCAGAGC
AGGATAGGATGGCAATGACCCTTCCCAGGAACTGCCAGAGGTCCAAACTCCAGCTGGAAAGGACAGTGTC
CACCTCTTCTCAGCCAGAAGAGAATGTGGACAGGGCAATGACATGCTTCCAAAAAAATCAGAGGAAAGT
GCTGCTCCAAGCAGGGAGAGACCAAAAGCCAAGTTATTGCCCAGAGGAGCCACAGCTCTTCCTCTCAGAA
CACCCTCTGGGGATCTAGCCATTACAGAGAAGGACCCTCCAGGGGTGGGAGTGGCTGGAGTGGCAGCTGC
CCCCAAGGGTAAAGAGAAGAATGGTGGGGCACGACTTGGGATGGCTGGAGTTCCAGAGGATGGAGAGCAG
CCGGGCTGGCCTTCTCCAGCCAAGGCTGCCCCCGTCCTCCCAACCACTCACAACCACAAAGTGCCAGTCC
TTATCTCACCCACTCTGAAACACACTCCAGCTGACGTGCAGCTCATTGGCACAGACTCTCAGGGGAATAA
ATTCAAGCTCTTATCTGAGCATCAGGTCACATCCTCTGGAGACAAGGACCGACCCCGACGGGTAAAACCA
AAGTGTGCCCCACCCCCACCACCAGTGATGAGACTACTGCAGCATCCGTCCATCTGCTCAGACCCTACAG
AAGAGCCAACTGCCCTAACTGCAGGACAGTCCACATCAGAAACACAGGAAGGAGGAAAGAAGGCAGCTCT
```

Figure 20 (Continued)

```
GGGCGCAGTGCCCATCAGTGGGAAAGCTGGGAGGCCAGTGATGCCTCCACCTCAAGTGCCTCTGCCCACA
TCTTCCATCTCGCCAGCCAAAATGGCCAATGGCACAGCAGGTACTAAAGTGGCTCTGAGAAAAACCAAAC
AGGCCGCTGAGAAAATCTCAGCAGACAAAATCAGCAAAGAGGCCCTGCTGGAATGTGCTGACCTACTGTC
CAGTGCACTCACGGAACCTGTGCCCAACAGCCAGCTGGTAGACACTGGACACCAGCTGCTTGACTACTGC
TCAGGCTATGTGGACTGCATCCCTCAAACTCGCAACAAATTTGCCTTCCGAGAGGCTGTGAGCAAACTGG
AACTCAGCCTGCAGGAGCTACAGGTTTCTTCAGCAGCTGCTGGTGTGCCCGGGACAAACCCTGTCCTTAA
TAACTTATTGTCATGTGTACAGGAAATCAGTGATGTGGTGCAGAGGTAGCCACTGTTAGCCTGGTGGGAA
AATGCACACATTTCTGAGGGGAGAGGGAAAAGGACTTGTTTTCCTGTGTTCTTGTTTTCAGAAAATGAAA
GACTCATACTTGAGTGTGTTTATGTGAAGTACCTCAGATCCCTGAGTTCTCACGTTTACAGTTTCATCTC
AAAAATAAGAAGCAAACCACATAAGTATAGGAGAGGTAAATTAAGTGGGGCAAGGCAGTAGTGGACAGG
GTTGGAAACTGCACTGGAAAATAGGGAACATGTGTATGTCATAAGGAAGGCAATGCAGCCCATCCCTACC
TGGAATGCTGGGAAGTGCTAGGCAGGGCTGCTCTCAGCAAGACTGCAGCAGCTGCACCCAGACCTGGGGC
TCTGGTAGGTACTAATGGTGATTATGCTCCAATTTACCTAATGAATTTGGTGGGACAGCAGAAAAGAAAG
CTGGGAATGTACCAAGAGAAATTTTTGTTCAGGGCTGTTGGAAGTAGCTGTTAGCCTTGCTTCCACAAGG
CCATTGCTGCTGTAATAAGAACTGCAAATCAGAGTGCTACAACATAAAACTGGGAAATATGGCCCTATCT
GAATGCCTCTGTCCTATTTTCCGCTGGTGTATCAGTTAGTGCAGGAAGTAAAGAATGCTGGAAAGTTGAA
TCAGAAATTGAAAACCTTCTAAAATCTTACACAGATTAGCAGAAGTCACTTCTCCCAGTCTGGTATATTA
TTTCATAATGGACCAGGATCGGCTTCCTGCCTGTTGGTGGCTATCTGTAAACCATAAGTACAGGGGTCTC
CCTAGTGGTTCTTCTCTGTCTTTTGCTGGGCAGGCTGTCTTCCTTTATTCCTGGTAGCATTCAGAGCATT
AACCAGTGTTGATTTTGAAAATAGTAGTCCCTACAGGTTCTCACAAAGGAATGAATCCTGTTCTGATACA
GTTCCCCTGCATACTGACATACTGGCCAAGGACTTGAGCAGCTGTGTATTTTTCTTTATCAACTAAAATA
CCAGGGAGATGGTCTTTTCTTGAAACCCAGTGGCCTGTATGTGACTGAGAGGAAAAGCTGGCTTGGTCCT
AATGGCTGTTTCTCTGTACCTTTCCCTTCCCTTACCACCTTAAGCCCAATCCAGGTAGAGAATAGGGAGA
GGCATTCTCCTCTCTATGGATTTGAAGTGAATCACCCCCACATTATTCTCACATGCTTTTCTTCTCTCAC
ATATTCCTCCCTACTCCCCCACCCAATCATTGTGCTTATTTGTACAGATCTTATTGGGAATATTCTTTAT
TTATTTTGTCATTTCACTTCTATTTTAAGAATGCATAATTGAAGGAGTAGTCATTTTCAGGGAGCACCAG
GTAGACCCTGGGAACCTAATGACTTAATCCTTAAATATGTTTTGCCCTTGAAAAATAGGCCTTTTCCTTC
CTTCCTTAGTTATAATTGTGGAAGCTAATTAGGATGGCATGGAAGTGAATCTAATGAGTTAGGTATTATT
AATGTTCTTGGTATCGGGTCTAATTCCAGTTACTGCTTCATTCTCTTTTTAAAGCTTTATGAATACTTCC
CCCATCCTCCCCAAGGAGAGCTCAATACACACATATTTTTATTTTATTCTCTCAAAGGAATATTAGCTTA
GGAAGATAGGAATTCAACATTGAGCACTGAGTTTTCTTCTGGCTCTGTCATTGATACACTGTCAAACCAC
AGCCTCATCTCTTAATCTATTTAATTAAGGTAACAGTACATGTTCTCAAGGGTGTTGCAAGTAAGTGTGC
AGCTATCCCTTGGAGAGCCTCTCTGGAAAGCTCTTTTAGTGCAGTGTTGTTATGCTGAATTGTTTTCCAT
TATCTTATTTGCTGAGTAGAAAATATTAATGAAATTAAGAATTGTTGAGATTATATGAATTGGGCTAGAA
TACTAAGGGGAAAACTATGTTTTGAATAGAGTTTGGCATTTTTGACCAAGAACAAAATTGAGTTTTCATT
GGAAAGAAAGGAAACCTTGATTCTTACCATTGCTGCTCCAAAGGAGGCCCAGGTTAAGAGGATTAGAGGA
GACACGCGGTGCTGGGCATTCCTGGCAGGTGTTGGGTGATCCCCGCAGTATGTCACCTGCAGTTGCAGCA
CAGGCAGCTAGTGATTGGGTTCATCTCCTCCTAGTGGTTGGAAGAGAACTCAGATGTAAAAACCAGCGGT
CCTTCTCCCACCTTCTTTCCTGCCATTCTTGCTCATCATACATGTCCGTAAACTTGAAGAACTCGTTTTA
GCAGCTAGCCTTTTAAGGTCGAGGATGGGAAAGCTAAAACTGTAGAATATTATTATGCTGCTTTTTAGGT
TTATCCCTGTTGTTGTGGGATGCAAGTTAAGGGATTGTAATTGTTTTTCAGGGTTTTTTGTTTTTTGTT
TTTTAAGCAAGGGCTCTATTTTCCCTTGAGAGTTCTGGAACTAAGCCTTGGAGAAACACTACTGAGTGTA
```

Figure 20 (Continued)

```
TTTAGGCTCCCTGGTTTTCTTGCCCAACAACAATCTGAAGGGTAGGGGGTGGGGGCTGTGTCTTACTCAG
GGGCAGCACCTAGCTGTCTTGCCTACAGTGGGTGCACGATATATAAATGGAATTGATTTTTGTCAACACT
GTCAAGAGTGGCATTGACTATTGGAGCATACCCCGTCCACATGATGCTTGAACTATGTAACTTCAGGGGT
TGAGGGCTCAAGGTTCAGGTTAAAGAGGCACTGTCAACTTACTATACAAGCATAATTTAGGTTTTTCCTT
TTTCTACTTGAAAAGGACCAGCTTAAACACAAACCCTTATGTAAATTAAAAGGTTTGAATCCAAAGCAGA
GAGAACTGCTTCTGGAAAAGTGTAGTTTAATTTTAACTATTCTAAAAGCAATGAGCAAAGGCCCTTGTCC
AAGGCGTTGACAGTTTTCTAAAGTGGTTATGCTGTATATCTGGATGCATGCCTTTGGGCTGCCACTGCTT
GATTCCTTTCATGTACAGATAATATTACTTCAGTTTAGATTTCCCACTTTAAAATGCAGTGATTTGTGTT
GAATACATCTTGATTGTGCTTTACCTAAAGTATTTTCTTAAAAGGCTTTGTGTAAAATTTAAATGTATAT
ATTTTCCTGTAGACTTCCATCATGATTTTCAGAGATTAGCCTTAAAAAATTTGGCCCTAAGAAATTCATT
CAGTGTTTTTCTAGATGACCTCTGTACATAGAGGTCATTATAGTGGAGACCCTTTACCAGCAGCATTTTA
AGATTTAAATTAGATAGAAAGTTTCTTAGGATTCAACTGAAAATTGGCTAGTAAAATATGTCCCAGGTAA
TAAAGCATGCTGACTTTGCTAAGGCACTGCCCATTTTTATTTAACTAAAGTCATGGAGATTTTGAGTTTA
AAGGATGCAGTATAGATAGTGGTTTAGTGTTTAGGCTCTAATGCCAGTCTAAAAGGCAAGTCATTTAACC
TTGGGAGCCTCAGTTTCCTCACTGTAAAACAGGGATAATAATAGTAACTACCTCAGGGTTGTTGTAAGGA
TTAAATGAGATGATATTTGTAAGATACTTAGCTCAAGTGCCTGGCACACAATGAGCACACTCTATAAATG
TTCTACTACTACTATTATTAACACCTAGTCTAGGGATGCACAGCAGAATCCCCTAGGGTTAAAAAACAAA
ACAAAACAAACAAAAAAAACTGACGGAATAGCCCCACTCCAGATCAGAATTCCCAGTGGGCTGGGGTCTC
GGCCAGTGTATTCTCCAGTAATCTCGCCAGGTGTTTGAAACACCCAGTGCTATCTGAAAACTATCAGTAC
CCCAACCCTTTGGTTTATAGATTAAGAAACTAGCAGAAGATGGTTAAATTACTTGCCTATTGTCTCAGAA
CGGTTAATTAGTGGCGGAGCCAAGGCTAGAATTCAAGTCTCTTGACTTTATGGTTGTGGGGTCTTTCCAC
CATACCTGCTGCCATGTGAGACACTGCAAAAAAGTGGCTCAGACCGACAATCAGCCTGTGTGGTGCTGCA
CACTTTCTAAAGCACATGCTCCTGACACTTTGACCTTAAGGGGCTTGAATGTGGAGTAATGGGAACACAA
GCCAAGCAAGCACTCAGTAGAATTCAGTCATTTAAAAAATTCAATGGGGTCATTCTTTTGGACAGACCTC
AGCAACACAGCAATGTGCACTTTGTAGTAAAGAAATACCAACTTGAGTTTTTAAAAAACCTAGTTAGTCC
TACATTCCCTTTTCTTTAAAAAAACTTTATTGTTCACATTATTTTAATGACTATGAGATAATGTATATGA
CAGCACTTTGAGAAAATATCAACTGTAATATAACTATAAGGTTGTAGTATTGTCTGTTTAAAAGATAAGA
CAGTTGATTCAATGTGGATGGACCCTGTGGGGTACCTGAAAATGTAGATACGTAAGAATCACCTCTGTCA
TTTATCACATTTAGAAATATGAAACTGCTTAACAGGTATGAGCAGGTATAGCAAGTGTTTGCTAAAGTTG
TAGTTCAGAGCTGAATTACTTCAGGAAACTAGGGACCAACTTTTTGGTTTAATTCCGATCTTTAAAAAGT
AAGAATGTGTACTCACTCCAGAACACAGAAGCTCTTCCAAGGACCTTGACTCAAGAAGGATGAGGTCCTC
TTACTCTTCTCCATTTATCCACTATATGCTTGGCCATTTATCCTAAATGTGGTGGGAACAGACTTGTTAT
CTGTTGATGTTGACAGTGTCTTTTTTAACCTATGTCCTGCATAGTTTTGTTAGGTTTACAGGGGGAGGTG
GATGGCCATAAAACCAGTGCACTTTGGGAATTACTTTTCTAGGATTTCCTACCAGTTATAAATGACATTG
ACATTTGTCATCTTTTTTTTCTTTTTCTAAAAAGAATAGCTGAATTTAATTCACCTATTATAAAATACTC
AAAAGTAAATTGCCTTGGTGGCCACTTCTGAATTATAGCTACATTTCATTATGACCCCTTCTGCTCCCTT
CCATTTTGCTACTGATGTCATTCTTGTTATCAGGCTGTGCCCCTACCAGGAGTTCATATTGGGTTGACAG
GGTTATCTATATTTTTGTTCTTGATTTTTGAGTTTCATCATCTTGCATTAAATTGTTCCACCTGGATTTG
GGGTTCATCTCTGTGCCCTAAGGATCTGCTATGACCAATCCTCTTTTTGTAGGTGGGTCTCTGGCTTAAG
TATTGATAGGCTTCAGCGGTTTGTGTCTCTGTCTTAGCTTGTATCAAGCCAGTAGTAGCTCACTTCCTTT
GTAAATTCCTGCTTCAGTCTGGGATCCGTAGGAGTATGTGAGAACTTCTGAAACGTCTCCAACTCTTAAC
AGTCAAGATATCTATATCATTTGGATAGAGTTCTGGTTTTCCAACTACTAGACTTAAAGAAATTCTGGCC
```

Figure 20 (Continued)

```
GGGTGCGGTGGCTCACGCCTGTAATCCCAGCACTTTGGGGGGCTGAGGCGGGTGGATCACGAGGTCAGGA
GATTGAGACCATCCTGGCTAACACGGTGAAACCCCACCTCTACTAAAAATACAAAAACTTAGCTGGGCGT
GGTGGCGGGCGCCTGTAGTCCCAGCTACTGGGGAGGCTGAGGCAGGAGAATGGCGTGAACCCAGGAGGCG
GAGCTTGCAGTGAGCCCAGATCGCGCCACTGCACTCCAGCCTGGGTGACAGTGAGACTCCGTCTCAAAAA
AAAAAAAAAAAAAAAAAAAAAAAAAAAAAGAAATTCTAATGCAAAGCTTGCTTTTTTTTCTTTTTTCC
AGCAAGCCAGTAGTAATAGTTATTGTTACTTGCTCTGTTCAGCACAACTGTAGTTCACTTGAACTTCACT
GTCATTCCCTACGCTCCTCTCTTACTGAGAAGCATGGGTGGGATTCAGGGCTGTGGGACAAGCTACAGCC
TACTCTGGAGCACTCACCCCCATGACTCAGTCCAGCCTGTCTCTTGGGAAGTTTATTGCAATGTGCAGAC
GGATGAATTTCTGCTTTTCATGCCACCTCTCTGAGGTATGTATTCTATCTTGAGTATGTACAAGATGATA
CCTTTTGGCTGGGCACAGTGGCTCGTGCCTGTAATCCCAGCACTTTGGGAGACCAAGATGGGCGGATCAC
TTGAGGTCAGGAGTTTGAGACCAGCCTGGCCAACATGGTGAAACCCCGTCTCTACTAAAAATATAAAAAT
TAGCCGGGCGTAGTACATGCCTGTAATCCCAGCTACTCCCGAGGCTGAGGCAGAATTGCTTGAACCCAGG
AGGCGGAGGTTGCAGTGAGCTGAGATCGCGCCGCTGCACTCCAGCCTAAGTGACAGAGTGAGACACGTTA
AGAAGAAAAAAAAAAAAAAGGATACCTTCATTTCTGACTCAATATCCTAGATCCAAAGGACAGGAAATTA
GGGAAGGCTTCACCCTGTGGGATCAAGATAAGAAGATCCCATACTTCTTCCCAGGTAAGGAGGCCTGTGG
CAGGTCATGATTCAAAGCTGACTTGGAATGGCAGAAACTGCTGAGAGGCCACCCTTGGAGATTTGTGCCT
TCAAAGATGGGTTTCATGAGTCTCAGAGAGGAAAAGACTTGTCAGCTGGGTTGATTTTGCATGATTATTG
AACTAGAGCTGGTAGACACGAGCTTCTCAGATGGCAGTGGCCAGATCCTCCATCTGTGAGAATCCGCCAC
TTGAAGTGGTTTCCTGAGAGTGTTCACTTGGCAGTTGCTGCGTTTCTCAAGCCCACCTGGCGAGGTCTCG
CCGGACCCTTCCCTCCAAGTGCACTTACTTCTTCATCCCCATGTACATCTCTAACTTTGAAATTGTTTAC
CTCTCCTACAAAAATCTTACCTTTTGACCTGAGCAGAGTAGCAAAGCCCTGTTCACTCTGAGGGAGCAGC
TGGCGTGTTGAAGGGGAAAGGCCAGGCACAGCACTGTCCTCAGACCACACCATATTTGGAGCAGAATTGT
GATACATGTCATCTGTGTCTATTCTGGAAGGTTCTTTGTTCATCACTGTACTCGCATCAGCAAATTTTCA
GGGTCCTACCTGTCACTCCAGGCTACTGAGCTGAACCCTCAGAAGCTGAGGTCTCCGAGCATGCTAAGTA
ACCTTTTAGAAAAGCTGGAGGCAAACTGTCGAATGCTAGCAGGCTTTATGAAAGGAAACATAAGGAGTTT
GTGTAGTCAGAACTTGCTTAAATTTGCTTCGGAATTAGGCACCATAAACTTTAGTTGGAGAATGGGACTT
AAATTTTCACATATATGTATACTTAATTTTCAGCAATTATGACACAATAAAAAGAATATGCAAATTTATT
GTTGTTTCAGAAGGTTTTGCAGGACTGGGAACGCTTTAGTGTCATCAACAGTAAACCTCAGATACTGTTC
TGCACAGTTCAGAAGTACCATACCAGGTATTGTGAGTGGCAAGAACGCCAGGGGACAGAGATGCTTCTGG
TAGATGAGGGCCAGAGAAACCAGCTCTCCTCCATTTTGACAGCAATTTCTCACTGTGGCCATTTGGCCTC
CATTATGTTTTGAGAGGAATTTCTTGAGATCTTGAGAAATCACCATGATTAGGCCAATTGTCAATCAGTA
TTCAGAAACTAGAAAGGAACAATGAGATACTTGTTTATGGTTCTTTAGGGCATATGTTTGAAAACCCTCT
CATCTCAGATCTGTATAGCTGGTGTGTGTTTGTGTCCATAAATACACGTGCATTGCTGTCGTGCCCATTA
AGAAAGGGGGAGTAAGTAAAAGAGGAATCGCTCAGATCTTTCCTTGGATGAACAGCAGTGGCGTGGTTGG
TGTGTTGACTGTGAACAGGCTGACTTAGCTGTTGATGTATACTCAGAACCTCCATCTCCTCCCAGACCCT
GCACTTTTCCTTCTCTGCAGTCTGATTCTCTAATGACTGTCACTGGACAAACCCCAGTTTTATGCTCGCT
TAGTAAAAATAAGTTTAAACATTTCATGGTGGTTGACAGAACTTTGTCCCCAAACATGCGGATTCAATTC
TTTAAAACTCGTTGAACGTTTATACCAAAGGTCCCGCCCCGCAGGTGTGTATGTGGTGCACAGAGGGTGA
GGTTTGGAGCATCGGGCACTGTGTGCATTGCTAAGGGGACATAGTGAGACAATGTGGGATTTAACTAAAA
ACACATCAATTGTGTGTCACATTACCAGTGTTGTCAGGTATTTGTTCTTAATTGTTATTGTAATATATTT
TCAGTTGTTTTTCTAATTTAATTCTCTCCGTCTGTTGTCTGACTGTGAACTGCTAACAGTGTTAAACTTG
ATGTAAATAAATGAGGCCCTTGAAAGGGACTGCTTTCTCTGTCTTCTCACAAGGTTTGCCAAGTTGTGTT
```

Figure 20 (Continued)

CTGTTTTAAATAAAGGTTGCAATATTTTATTGGCAAAGTAAAAAAAAAAAAAAAAAA

>gi|156547090|ref|NM_005233.5| Homo sapiens EPH receptor A3 (EPHA3), transcript variant 1, mRNA
CCCGCTCTGCTTCAGCGCACGCTGAAGACGGCACTAGGACCCAGGGAAGTCCCCGAGCGGGGTTCGCGGA
AAGGCAGCCAGACTCCTCCTTATCTCCAGTGTCAAACTTGACATCAGCCTGCGAGCGGAGCATGGTAACT
TCTCCAGCAATCAGAGCGCTCCCCCTCACATCAGTGGCATGCTTCATGGAGATATGCTCCTCTCACTGCC
CTCTGCACCAGCAACATGGATTGTCAGCTCTCCATCCTCCTCCTTCTCAGCTGCTCTGTTCTCGACAGCT
TCGGGGAACTGATTCCGCAGCCTTCCAATGAAGTCAATCTACTGGATTCAAAAACAATTCAAGGGGAGCT
GGGCTGGATCTCTTATCCATCACATGGGTGGGAAGAGATCAGTGGTGTGGATGAACATTACACACCCATC
AGGACTTACCAGGTGTGCAATGTCATGGACCACAGTCAAAACAATTGGCTGAGAACAAACTGGGTCCCCA
GGAACTCAGCTCAGAAGATTTATGTGGAGCTCAAGTTCACTCTACGAGACTGCAATAGCATTCCATTGGT
TTTAGGAACTTGCAAGGAGACATTCAACCTGTACTACATGGAGTCTGATGATGATCATGGGGTGAAATTT
CGAGAGCATCAGTTTACAAAGATTGACACCATTGCAGCTGATGAAAGTTTCACTCAAATGGATCTTGGGG
ACCGTATTCTGAAGCTCAACACTGAGATTAGAGAAGTAGGTCCTGTCAACAAGAAGGGATTTTATTTGGC
ATTTCAAGATGTTGGTGCTTGTGTTGCCTTGGTGTCTGTGAGAGTATACTTCAAAAAGTGCCCATTTACA
GTGAAGAATCTGGCTATGTTTCCAGACACGGTACCCATGGACTCCCAGTCCCTGGTGGAGGTTAGAGGGT
CTTGTGTCAACAATTCTAAGGAGGAAGATCCTCCAAGGATGTACTGCAGTACAGAAGGCGAATGGCTTGT
ACCCATTGGCAAGTGTTCCTGCAATGCTGGCTATGAAGAAAGAGGTTTTATGTGCCAAGCTTGTCGACCA
GGTTTCTACAAGGCATTGGATGGTAATATGAAGTGTGCTAAGTGCCCGCCTCACAGTTCTACTCAGGAAG
ATGGTTCAATGAACTGCAGGTGTGAGAATAATTACTTCCGGGCAGACAAAGACCCTCCATCCATGGCTTG
TACCCGACCTCCATCTTCACCAAGAAATGTTATCTCTAATATAAACGAGACCTCAGTTATCCTGGACTGG
AGTTGGCCCCTGGACACAGGAGGCCGGAAAGATGTTACCTTCAACATCATATGTAAAAAATGTGGGTGGA
ATATAAAACAGTGTGAGCCATGCAGCCCAAATGTCCGCTTCCTCCCTCGACAGTTTGGACTCACCAACAC
CACGGTGACAGTGACAGACCTTCTGGCACATACTAACTACACCTTTGAGATTGATGCCGTTAATGGGGTG
TCAGAGCTGAGCTCCCCACCAAGACAGTTTGCTGCGGTCAGCATCACAACTAATCAGGCTGCTCCATCAC
CTGTCCTGACGATTAAGAAAGATCGGACCTCCAGAAATAGCATCTCTTTGTCCTGGCAAGAACCTGAACA
TCCTAATGGGATCATATTGGACTACGAGGTCAAATACTATGAAAAGCAGGAACAAGAAACAAGTTATACC
ATTCTGAGGGCAAGAGGCACAAATGTTACCATCAGTAGCCTCAAGCCTGACACTATATACGTATTCCAAA
TCCGAGCCCGAACAGCCGCTGGATATGGGACGAACAGCCGCAAGTTTGAGTTTGAAACTAGTCCAGACTC
TTTCTCCATCTCTGGTGAAAGTAGCCAAGTGGTCATGATCGCCATTTCAGCGGCAGTAGCAATTATTCTC
CTCACTGTTGTCATCTATGTTTTGATTGGGAGGTTCTGTGGCTATAAGTCAAAACATGGGGCAGATGAAA
AAAGACTTCATTTTGGCAATGGGCATTTAAAACTTCCAGGTCTCAGGACTTATGTTGACCCACATACATA
TGAAGACCCTACCCAAGCTGTTCATGAGTTTGCCAAGGAATTGGATGCCACCAACATATCCATTGATAAA
GTTGTTGGAGCAGGTGAATTTGGAGAGGTGTGCAGTGGTCGCTTAAAACTTCCTTCAAAAAAAGAGATTT
CAGTGGCCATTAAGACCCTGAAAGTTGGCTACACAGAAAAGCAGAGGAGAGACTTCCTGGGAGAAGCAAG
CATTATGGGACAGTTTGACCACCCCAATATCATTCGACTGGAAGGAGTTGTTACCAAAAGTAAGCCAGTT
ATGATTGTCACAGAATACATGGAGAATGGTTCCTTGGATAGTTTCCTACGTAAACACGATGCCCAGTTTA
CTGTCATTCAGCTAGTGGGGATGCTTCGAGGGATAGCATCTGGCATGAAGTACCTGTCAGACATGGGCTA
TGTTCACCGAGACCTCGCTGCTCGGAACATCTTGATCAACAGTAACTTGGTGTGTAAGGTTTCTGATTTC
GGACTTTCGCGTGTCCTGGAGGATGACCCAGAAGCTGCTTATACAACAAGAGGAGGGAAGATCCCAATCA
GGTGGACATCACCAGAAGCTATAGCCTACCGCAAGTTCACGTCAGCCAGCGATGTATGGAGTTATGGGAT Figure 20 (Continued)

```
TGTTCTCTGGGAGGTGATGTCTTATGGAGAGAGACCATACTGGGAGATGTCCAATCAGGATGTAATTAAA
GCTGTAGATGAGGGCTATCGACTGCCACCCCCCATGGACTGCCCAGCTGCCTTGTATCAGCTGATGCTGG
ACTGCTGGCAGAAAGACAGGAACAACAGACCCAAGTTTGAGCAGATTGTTAGTATTCTGGACAAGCTTAT
CCGGAATCCCGGCAGCCTGAAGATCATCACCAGTGCAGCCGCAAGGCCATCAAACCTTCTTCTGGACCAA
AGCAATGTGGATATCACTACCTTCCGCACAACAGGTGACTGGCTTAATGGTGTCTGGACAGCACACTGCA
AGGAAATCTTCACGGGTGTGGAGTACAGTTCTTGTGACACAATAGCCAAGATTTCCACAGATGACATGAA
AAAGGTTGGTGTCACCGTGGTTGGGCCACAGAAGAAGATCATCAGTAGCATTAAAGCTCTAGAAACGCAA
TCAAAGAATGGCCCAGTTCCCGTGTAAAGCACGGGACGGAAGTGCTTCTGGACGGAAGTGGTGGCTGTGG
AAGGCGTAGCATCATCCTGCAGACAGACAATAATTCTGGAGATACTGGTGGAAGTTCCAAGTCCAATAAG
ACACTCAAATATGAGTACAAATGCCTTAAAATGGAATTGAAAAACTCTTTATTTTCCCCTATCATTTATT
GGATGGTGGGTGGGGTATTTTTTTGTAATTGCTTTTTTAAATATTAGTTAATGGATTAAATTTAATTCT
TCAGCGTAAAATGGTGAAGAACTAGCATATAGCCATTGATCATAAACTGACTATCATAAAATCAAAACAA
GTGAAATAACAAAATGGACATGGTGGCTTTGTTTAGGTAGAGCCACAAAAGAAAAGACTTGTAATATTTT
TATATACAGAGGAAATCTGTAACAGGTATTTTGTTTCTTTTAAAGCAAGCAACACAGAGGAATTTATACC
TCAAACTATCTGGCCATATTTACTACCTTATCACTGCATTATTCTCTTTTATCTGTTTAAAGCATATAGA
GATGAAGTTTGTAGTTGTTTTAAGTACTACACATTTTTAAATTGTTAGCTTCCTTAAGTATATCATGTAA
AGAAATGTCTTAATTTTTGAAAAAAGTACATATTTATTTTCTTTTGAATTGTTTTTATTGTTTTCTATTT
ATGCCTTGATGATTTAATATGGATTTGTTACAGCCAAGTGCCAAATGCTCTCTCAAATTGTCAGCAATTT
AACTAGACACAGATAATAATGGGTTTCTTTCAGATTTTTTGAACCATCCACTTACATATATTTTTAAAAA
ATGAAATCCTTTTCCTGTTCATACACTAACCAAATCTCTCAAATCTGTTATCCCAATCATTGTTGCCTCT
CCGTTTATTATAAACTGTATGCTCACAACTTAGTGTAATATACCAGCTTGTATGCAATGGATTTTCAACC
AGATAACATACCTTTCCTGCTCTGGTGCTTAGAGACTATCAACTCCCTCCTTTAGTGAAGGAGCCGTGTT
AGAGCTTCCGAGAATAGCTCCACTGGAGAGAAGTGGAATCCTATATAGAATGCTGCACTAATTGACAACA
CAGCCTATAGGCCAATGCATGAGTAAAAAAAAAAACAATTACTGGCTCACTGGCTTTGAAAAGTCACTTA
CTATTGTTGCTGAAACTTGCTGAGCTGTTTATAGAGAATGATGATAACAGAACTTTTCCTCTGTATCACT
GGTGTTTAGGTGAATTAATTAAACATTGTGATCATTAGTACCAGGTATTATTATCTTTAAGAGTCTTCCA
CTTCAATGCACATGGTGCAGTTTTGGTGTGTAACTTAGAAGGATTGAACTTCTTTGAATTTACTGGACAT
AACATTTTCAGAATAGTTGGTCATCTAGCAACCGCCTCAAAATGTGTAAGCAGGAGAGAAATTTCTCATC
ACAGGGATTTAGACTTACTATTACATAAAGGCTAACTATGAGCTTGCTCATTAATTTTGAAAAGATGTAC
CTGGTGGATATCTAGCTAGTAATATATTCTGAAGCAACATTTTAGCTCTATTGATACTCTTTCTAATGCT
GATATGATCTTGAGTATAAGAAATGCATATGTCACTAGAATGGATAAAATAATGCTGCAAACTTAATGTT
CTTATGCAAAATGGAACGCTAATGAAACACAGCTTACAATCGCAAATCAAAACTCACAAGTGCTCATCTG
TTGTAGATTTAGTGTAATAAGACTTAGATTGTGCTCCTTCGGATATGATTGTTTCTCAAATCTTGGCAAT
ATTCCTTAGTCAAATCAGGCTACTAGAATTCTGTATTGGATATATAAGAGCATGAAATTTTTAAAAATAC
ACTTGTGATTATAAAATTAATCACAAATTTCACTTATACCTGCTATCAGCAGCTAGAAAACATTTTTTT
TTAAATCAAGTATTTTGTGTTTGGAATGTTAGAATGAGATCTGAATGTGGTTTCAATCTAATTTTTTCCC
AGACTACTATTTTCTTTTTTAGGTACTATTCTGAGCATACTCAACAAAACCCATGCATTTCATAAACTAA
TAGAAGTTGAGGATTGTTGAATCTATTTCACTTATTTTGGCTGTGGTTTCCATCTGAAAGTAGAGGTTGT
ATACACCATATACTGTTCTTCATTTTATTAATATTTTTCTCCTTGACCTCTCATAAATTTACTTTACACA
ATTCTTACCCTGTACATATGTAAACATAAGTGTACGATTCTTAACCATGGAGTAGAGGTACTAGAATGCT
TACGGCCATCTCTTTGTACAGGAACTGCATTGACTTTCAGTAAACATAAAGCCACAACTCCTACATGATG
TTATGTACCATATGATCTGTTTTGTATCTTAAATTTGATTTACATATATTATTTATTTCTGGTAACTCAC
```

Figure 20 (Continued)

```
TCAGTTTATGCTGTGCTAAATATCAATCAAGCCATGTATAAATGTGATATGATTGGCAATATGTGTTTAC
TTTAAACTTGTCTTTTCAAAATATTACTCAGTTTATGTTGTACAATGTAGATGGCCTCTTACTAATGTAA
AATGATTTGTAGTGGAAACATTTATATTTTTATAATAAACATAATGAAAATATTTTTTACAGATTGGAAA
AAAAAAAAAAAAAAAAAAAAAAAAAA

>gi|47078282|ref|NM_005565.3| Homo sapiens lymphocyte cytosolic protein 2 (SH2
domain containing leukocyte protein of 76kDa) (LCP2), mRNA
GAAGAGACCATATTTGTTCGCAGAGGAAGCCGTTGCTTTCTGGGATCTGGCTACGCCAGAAAAGACATCG
GCTCCAACAGGGGTGTTCCACAGGGTAGCTGGGAGTTGGAAGAGCCAAGAACGCCTCCGAGCTCTGGATT
TGAGCTTCTCTGCCCATGGGTGAAGCGCCCATGCTCAGCTTGTGAGCTTCTTCCCGGGAGAGCAGCCATG
GCACTGAGGAATGTGCCCTTTCGCTCAGAGGTCCTGGGCTGGGACCCCGACAGCCTTGCTGACTATTTCA
AGAAGCTCAACTATAAGGACTGTGAGAAGGCAGTGAAGAAGTACCACATCGATGGGGCTCGCTTCTTGAA
CCTGACAGAAAATGACATCCAGAAGTTCCCCAAGCTCCGGGTGCCGATTCTCAGTAAGTTAAGTCAGGAA
ATCAACAAGAACGAAGAGAGGAGGAGCATCTTCACACGCAAACCCCAAGTCCCGCGGTTTCCTGAAGAGA
CAGAAAGCCACGAAGAGGACAATGGGGGCTGGTCGTCCTTTGAAGAAGACGATTATGAAAGTCCCAATGA
TGACCAGGATGGGGAGGATGATGGAGACTATGAGTCCCCCAATGAGGAGGAAGAGGCACCCGTGGAAGAT
GACGCGGATTATGAGCCGCCACCCTCCAATGACGAGGAAGCTCTGCAGAACTCCATCCTGCCTGCCAAGC
CTTTCCCCAACTCCAACTCCATGTACATCGACCGGCCCCCTCTGGAAAACCCCCAGCAGCCTCCTGT
GCCCCCCAGAGACCGATGGCCGCCCTCCCGCCCCCACCAGCCGGCCGGAATCACTCGCCACTGCCCCCA
CCCCAGACCAACCACGAAGAACCCAGCAGAAGCAGAAACCACAAAACGGCAAAGCTCCCTGCTCCTTCAA
TAGACAGAAGCACGAAACCTCCCCTAGATCGTTCATTAGCTCCGTTTGATAGAGAACCCTTCACACTAGG
AAAGAAACCACCATTTTCTGACAAGCCCTCGATTCCAGCGGGAAGGTCACTCGGGGAGCATTTACCCAAG
ATTCAAAAGCCTCCTTTACCACCGACCACGGAAAGACATGAAAGGAGCAGCCCCCTGCCAGGGAAGAAGC
CACCTGTGCCAAAGCATGGATGGGGACCAGACAGAAGAGAGAATGATGAAGATGATGTGCATCAGAGACC
TTTGCCCCAGCCAGCACTACTTCCTATGAGCTCCAACACTTTCCCTTCAAGATCTACTAAGCCAAGTCCC
ATGAACCCTCTCCCATCCTCTCACATGCCTGGAGCATTCTCAGAAAGTAACAGCAGTTTTCCACAGAGTG
CCTCCCTGCCACCATACTTCTCTCAAGGCCCTAGCAACAGACCACCTATCAGAGCCGAAGGCAGAAACTT
CCCCTTGCCACTTCCAAACAAACCTCGGCCCCCATCCCCCGCGGAGGAAGAGAATTCATTAAATGAAGAG
TGGTACGTTTCTTATATTACCCGACCAGAGGCAGAAGCTGCTCTTAGAAAGATAAACCAGGATGGCACAT
TTCTGGTCAGAGACAGCTCTAAAAAAACAACAACCAATCCATATGTCCTCATGGTGTTGTACAAAGATAA
AGTTTACAACATCCAGATCCGTTATCAGAAGGAAAGTCAAGTTTACTTGTTGGGAACTGGACTCCGAGGG
AAAGAGGACTTTCTGTCTGTGTCAGATATTATTGACTACTTCAGGAAAATGCCACTTCTGCTCATTGATG
GGAAAAACCGAGGTTCCAGATACCAGTGCACATTAACGCATGCTGCAGGGTACCCATAGCAAGTTATAGC
CGAGCAAATGAACCGTCCTCCTGCCTCTGTTGCCAACACGAGATCAATCAGCCTTGGTCAATGGACAAAC
ACTTAGGACTGAACTGAACCCCTCCCCATGAACACAAGGGTTTTATCCTTTCCTTTAAAAACAGTGTTTG
AAATGAAGACTGTCAACTATCCCATAATTTATTTATTCTTCTTCAATGTTTGTAAAGTGCATGAGTCATG
TTCACACTTGAAGTCTAGTAGTGCACTGTAATAATTCATTTTTTAAAAGATTATTTAATGCCCATTTCAA
AATACAGTAGTTTACACAGCTACAGAAACAATTTGGGGCAAGTTTTAAAACACTGAAACAGTAATAGTTA
TTGGTGTCACATAAAACTGATTTGTTTTTTACAGCCAAACCTCTGTCAGTCAGAGGCATTCATTAGTTTT
ATACATGTAATTTGAAAATCACTAAACCTCGTTTTCTCAGCAGCAATAATTTAAGAGGCTTCAAAAATAT
AATTTCACTCTTATTTAGTATTTTTTCCTGGGGCATTTTTACGTAATTTTTTTATGAAAAGACAAATGC
ATGTTGAGATAACTTCTGGGATTAAAATAGTCTTTTGCTTTAAAAAAAAAAAAAAAAAAAAAAAAAAAA
```

Figure 20 (Continued)

AAAAAAAAAAAAAAAAAAAAAA

>gi|207028465|ref|NM_005566.3| Homo sapiens lactate dehydrogenase A (LDHA),
transcript variant 1, mRNA
GTCTGCCGGTCGGTTGTCTGGCTGCGCGCGCCACCCGGGCCTCTCCAGTGCCCCGCCTGGCTCGGCATCC
ACCCCCAGCCCGACTCACACGTGGGTTCCCGCACGTCCGCCGGCCCCCCCCGCTGACGTCAGCATAGCTG
TTCCACTTAAGGCCCCTCCCGCGCCCAGCTCAGAGTGCTGCAGCCGCTGCCGCCGATTCCGGATCTCATT
GCCACGCGCCCCGACGACCGCCCGACGTGCATTCCCGATTCCTTTTGGTTCCAAGTCCAATATGGCAAC
TCTAAAGGATCAGCTGATTTATAATCTTCTAAAGGAAGAACAGACCCCCCAGAATAAGATTACAGTTGTT
GGGGTTGGTGCTGTTGGCATGGCCTGTGCCATCAGTATCTTAATGAAGGACTTGGCAGATGAACTTGCTC
TTGTTGATGTCATCGAAGACAAATTGAAGGGAGAGATGATGGATCTCCAACATGGCAGCCTTTTCCTTAG
AACACCAAAGATTGTCTCTGGCAAAGACTATAATGTAACTGCAAACTCCAAGCTGGTCATTATCACGGCT
GGGGCACGTCAGCAAGAGGGAGAAAGCCGTCTTAATTTGGTCCAGCGTAACGTGAACATCTTTAAATTCA
TCATTCCTAATGTTGTAAAATACAGCCCGAACTGCAAGTTGCTTATTGTTTCAAATCCAGTGGATATCTT
GACCTACGTGGCTTGGAAGATAAGTGGTTTTCCCAAAAACCGTGTTATTGGAAGCGGTTGCAATCTGGAT
TCAGCCCGATTCCGTTACCTAATGGGGAAAGGCTGGGAGTTCACCCATTAAGCTGTCATGGGTGGGTCC
TTGGGGAACATGGAGATTCCAGTGTGCCTGTATGGAGTGGAATGAATGTTGCTGGTGTCTCTCTGAAGAC
TCTGCACCCAGATTTAGGGACTGATAAAGATAAGGAACAGTGGAAAGAGGTTCACAAGCAGGTGGTTGAG
AGTGCTTATGAGGTGATCAAACTCAAAGGCTACACATCCTGGGCTATTGGACTCTCTGTAGCAGATTTGG
CAGAGAGTATAATGAAGAATCTTAGGCGGGTGCACCCAGTTTCCACCATGATTAAGGGTCTTTACGGAAT
AAAGGATGATGTCTTCCTTAGTGTTCCTTGCATTTTGGGACAGAATGGAATCTCAGACCTTGTGAAGGTG
ACTCTGACTTCTGAGGAAGAGGCCCGTTTGAAGAAGAGTGCAGATACACTTTGGGGGATCCAAAAGGAGC
TGCAATTTTAAAGTCTTCTGATGTCATATCATTTCACTGTCTAGGCTACAACAGGATTCTAGGTGGAGGT
TGTGCATGTTGTCCTTTTTATCTGATCTGTGATTAAAGCAGTAATATTTTAAGATGGACTGGGAAAAACA
TCAACTCCTGAAGTTAGAAATAAGAATGGTTTGTAAAATCCACAGCTATATCCTGATGCTGGATGGTATT
AATCTTGTGTAGTCTTCAACTGGTTAGTGTGAAATAGTTCTGCCACCTCTGACGCACCACTGCCAATGCT
GTACGTACTGCATTTGCCCCTTGAGCCAGGTGGATGTTTACCGTGTGTTATATAACTTCCTGGCTCCTTC
ACTGAACATGCCTAGTCCAACATTTTTTCCCAGTGAGTCACATCCTGGGATCCAGTGTATAAATCCAATA
TCATGTCTTGTGCATAATTCTTCCAAAGGATCTTATTTTGTGAACTATATCAGTAGTGTACATTACCATA
TAATGTAAAAAGATCTACATACAAACAATGCAACCAACTATCCAAGTGTTATACCAACTAAAACCCCCAA
TAAACCTTGAACAGTGACTACTTTGGTTAATTCATTATATTAAGATATAAAGTCATAAAGCTGCTAGTTA
TTATATTAATTTGGAAATATTAGGCTATTCTTGGGCAACCCTGCAACGATTTTTTCTAACAGGGATATTA
TTGACTAATAGCAGAGGATGTAATAGTCAACTGAGTTGTATTGGTACCACTTCCATTGTAAGTCCCAAAG
TATTATATATTTGATAATAATGCTAATCATAATTGGAAAGTAACATTCTATATGTAAATGTAAAATTTAT
TTGCCAACTGAATATAGGCAATGATAGTGTGTCACTATAGGGAACACAGATTTTTGAGATCTTGTCCTCT
GGAAGCTGGTAACAATTAAAAACAATCTTAAGGCAGGGAAAAAAAAAAAAAAAAAA >gi|197245402|ref|NM_005735.3| Homo sapiens ARP1 actin-related protein 1 homolog
B, centractin beta (yeast) (ACTR1B), mRNA
CTGCTGTCAATCGGGCCAGGTGGGAGCGATGATTGGCCGCCGGGCCCGCCCTCCAGAAAGCCCCGCGGGG
CTCGCGTAGGCTGCAGGCTCGGGGAGGGAGGGCAGCGGCGCCGCGTCGGGAGCCGCCGCCGTCCCGGTCC
TCCCGCCCGCCCGCCCATCCGGTGCCTCCTGCAGCCCGCCTGCTGGGCAGGGCCGGCGCGGCCCGGCCAT

Figure 20 (Continued)

```
GGAGTCCTACGACATCATCGCCAACCAGCCTGTGGTCATCGACAACGGTTCGGGGGTGATTAAAGCTGGC
TTTGCAGGAGACCAGATTCCCAAATACTGTTTCCCAAACTATGTCGGGCGGCCGAAGCACATGCGGGTGA
TGGCTGGAGCCCTGGAGGGGGACCTCTTCATCGGACCAAAAGCAGAGGAGCACCGGGGGCTGCTGACCAT
CCGCTACCCCATGGAGCACGGCGTGGTGCGAGACTGGAACGACATGGAACGCATCTGGCAGTACGTCTAC
TCCAAGGATCAGCTGCAGACCTTCTCGGAGGAGCATCCTGTGCTCCTCACGGAGGCCCCGCTCAACCCGA
GTAAGAACCGGGAGAAGGCGGCAGAGGTGTTCTTTGAGACCTTCAACGTGCCGGCCCTGTTCATCTCCAT
GCAGGCTGTGCTCAGTCTGTACGCAACAGGACGCACGACAGGAGTGGTTCTAGACTCAGGGGACGGGGTC
ACTCATGCTGTGCCCATCTATGAGGGCTTTGCCATGCCTCACTCCATCATGCGGGTGGACATTGCCGGCC
GCGACGTCTCCCGCTACCTCCGACTCCTGCTGCGCAAGGAAGGGGTTGACTTCCATACCTCGGCTGAGTT
TGAGGTTGTCCGGACAATCAAAGAGCGAGCGTGCTACCTGTCCATCAACCCACAGAAGGATGAGGCTCTG
GAGACGGAGAAGGTGCAGTACACGTTGCCAGACGGCAGCACGCTTGATGTGGGGCCTGCACGATTCCGGG
CCCCCGAGCTGCTGTTCCAGCCGGACCTTGTCGGGGATGAGAGTGAGGGGCTCCATGAGGTGGTGGCCTT
CGCCATACACAAGTCCGACATGGACCTGCGCCGGACGCTGTTCGCCAACATCGTGCTCTCAGGTGGCTCA
ACGCTTTTCAAAGGCTTCGGAGACCGATTACTCAGTGAAGTGAAGAAGCTTGCCCCAAAGGATATCAAAA
TCAAGATCTCAGCCCCGCAGGAACGGCTGTACTCCACATGGATTGGCGGCTCCATCCTGGCCTCGCTGGA
CACTTTTAAGAAGATGTGGGTGTCCAAAAAGGAGTATGAAGAGGATGGCTCCCGTGCTATTCATCGCAAA
ACTTTCTAGTGCCCAAGGAGGGCGGGGCATGTTGGGAGAGGGGGAGGGAGGGGAGACAGAGCCTTTAACC
CTTTTTGGTCTTGGCTCGTATACTAGGCTTAGGGTCCCCTGCATGCCCTGAACCCCTGGGTGGGTGGCAC
AGCAGTGCCCCCCTGCAGCCTTCCCCTCTACACAGGACATGCACACACAAGTAACATTGAGCTGCATGGA
CAGGAGCCTTGAGCTGGCGTGTGGGAATTGAGCGCCATGTCAGGCTGTTGTGGGTATCCCCCTGGCAGGG
CCAGCTAGGCCTGTGGTTCCCTGCTCCGACTCTCAGGGCTGCCTCCCTGAGCTCCAGGGCCAGAATGCCT
GGATGCCTGGGTAGCCAGTTTGGGGAGTGGGCTGCAAGGGCAGCCAGCAGCTCCCACTGGTGTGTCACT
GCATCCATTGCCACCTCCTGTTCGTGACCTGACAGGGTGACACAGCCCCTTTCACACTCTGTCCTCCTAT
CTTCCTGGGTAGATGCCCTGGTGTAGGGCTGAGTACTGAATGGTCTTCCATCCCCAGCAAGGGGGTGCAG
CCCAGGGTCAGGCCCTTCAGAGCCAGGGCAGAGGATGCACGGTGGCTAGAGCCGCTGCACTATCCTTTTC
AGAGCACTTCATCCACTTGCTCCTCCCTCTACCCTCGGCACCCTGGGTGGGAAAGGGTTGATGCTCATCA
TTTATTGAGGGGAAGCCACTTAATAAGGAGTCAGACCTAAAAGGGGGTGGGGGACATTTTCTTACCTCAC
CCAAGAAAGAGGTCGTCACTTTTGCTGTGGCCAGGGCCCCACCTCCCTCTCTCAGATATGTACAATAATT
TAACACGGTTGCCTGAAAAAAACTTTTGTAAATCATTATAGTAATAATTATGGACAAGGCCCAGTGTGTG
GCTCTGTTTTCTTGTGGC

>gi|334848124|ref|NM_006257.3| Homo sapiens protein kinase C, theta (PRKCQ),
transcript variant 1, mRNA
CCGCCAGTCCCCGCGCAGTCCCCGCGCAGTCCCCGCGCAGTCCCAGCGCCACCGGGCAGCAGCGGCGCCG
TGCTCGCTCCAGGGCGCAACCATGTCGCCATTTCTTCGGATTGGCTTGTCCAACTTTGACTGCGGGTCCT
GCCAGTCTTGTCAGGGCGAGGCTGTTAACCCTTACTGTGCTGTGCTCGTCAAAGAGTATGTCGAATCAGA
GAACGGGCAGATGTATATCCAGAAAAAGCCTACCATGTACCCACCCTGGGACAGCACTTTTGATGCCCAT
ATCAACAAGGGAAGAGTCATGCAGATCATTGTGAAAGGCAAAAACGTGGACCTCATCTCTGAAACCACCG
TGGAGCTCTACTCGCTGGCTGAGAGGTGCAGGAAGAACAACGGGAAGACAGAAATATGGTTAGAGCTGAA
ACCTCAAGGCCGAATGCTAATGAATGCAAGATACTTTCTGGAAATGAGTGACACAAAGGACATGAATGAA
TTTGAGACGGAAGGCTTCTTTGCTTTGCATCAGCGCCGGGGTGCCATCAAGCAGGCAAAGGTCCACCACG
TCAAGTGCCACGAGTTCACTGCCACCTTCTTCCCACAGCCCACATTTTGCTCTGTCTGCCACGAGTTTGT
```

Figure 20 (Continued)

CTGGGGCCTGAACAAACAGGGCTACCAGTGCCGACAATGCAATGCAGCAATTCACAAGAAGTGTATTGAT
AAAGTTATAGCAAAGTGCACAGGATCAGCTATCAATAGCCGAGAAACCATGTTCCACAAGGAGAGATTCA
AAATTGACATGCCACACAGATTTAAAGTCTACAATTACAAGAGCCCGACCTTCTGTGAACACTGTGGGAC
CCTGCTGTGGGGACTGGCACGGCAAGGACTCAAGTGTGATGCATGTGGCATGAATGTGCATCATAGATGC
CAGACAAAGGTGGCCAACCTTTGTGGCATAAACCAGAAGCTAATGGCTGAAGCGCTGGCCATGATTGAGA
GCACTCAACAGGCTCGCTGCTTAAGAGATACTGAACAGATCTTCAGAGAAGGTCCGGTTGAAATTGGTCT
CCCATGCTCCATCAAAAATGAAGCAAGGCCGCCATGTTTACCGACACCGGGAAAAAGAGAGCCTCAGGGC
ATTTCCTGGGAGTCTCCGTTGGATGAGGTGGATAAAATGTGCCATCTTCCAGAACCTGAACTGAACAAAG
AAAGACCATCTCTGCAGATTAAACTAAAAATTGAGGATTTTATCTTGCACAAAATGTTGGGGAAAGGAAG
TTTTGGCAAGGTCTTCCTGGCAGAATTCAAGAAAACCAATCAATTTTTCGCAATAAAGGCCTTAAAGAAA
GATGTGGTCTTGATGGACGATGATGTTGAGTGCACGATGGTAGAGAAGAGAGTTCTTTCCTTGGCCTGGG
AGCATCCGTTTCTGACGCACATGTTTTGTACATTCCAGACCAAGGAAAACCTCTTTTTTGTGATGGAGTA
CCTCAACGGAGGGGACTTAATGTACCACATCCAAAGCTGCCACAAGTTCGACCTTTCCAGAGCGACGTTT
TATGCTGCTGAAATCATTCTTGGTCTGCAGTTCCTTCATTCCAAAGGAATAGTCTACAGGGACCTGAAGC
TAGATAACATCCTGTTAGACAAAGATGGACATATCAAGATCGCGGATTTTGGAATGTGCAAGGAGAACAT
GTTAGGAGATGCCAAGACGAATACCTTCTGTGGGACACCTGACTACATCGCCCAGAGATCTTGCTGGGT
CAGAAATACAACCACTCTGTGGACTGGTGGTCCTTCGGGGTTCTCCTTTATGAAATGCTGATTGGTCAGT
CGCCTTTCCACGGGCAGGATGAGGAGGAGCTCTTCCACTCCATCCGCATGGACAATCCCTTTTACCCACG
GTGGCTGGAGAAGGAAGCAAAGGACCTTCTGGTGAAGCTCTTCGTGCGAGAACCTGAGAAGAGGCTGGGC
GTGAGGGGAGACATCCGCCAGCACCCTTTGTTTCGGGAGATCAACTGGGAGGAACTTGAACGGAAGGAGA
TTGACCCACCGTTCCGGCCGAAAGTGAAATCACCATTTGACTGCAGCAATTTCGACAAAGAATTCTTAAA
CGAGAAGCCCCGGCTGTCATTTGCCGACAGAGCACTGATCAACAGCATGGACCAGAATATGTTCAGGAAC
TTTTCCTTCATGAACCCCGGGATGGAGCGGCTGATATCCTGAATCTTGCCCCTCCAGAGACAGGAAAGAA
TTTGCCTTCTCCCTGGGAACTGGTTCAAGAGACACTGCTTGGGTTCCTTTTTCAACTTGGAAAAAGAAAG
AAACACTCAACAATAAAGACTGAGACCCGTTCGCCCCCATGTGACTTTTATCTGTAGCAGAAACCAAGTC
TACTTCACTAATGACGATGCCGTGTGTCTCGTCTCCTGACATGTCTCACAGACGCTCCTGAAGTTAGGTC
ATTACTAACCATAGTTATTTACTTGAAAGATGGGTCTCCGCACTTGGAAAGGTTTCAAGACTTGATACTG
CAATAAATTATGGCTCTTCACCTGGGCGCCAACTGCTGATCAATGAAATGCTTGTTGAATCAGGGGCAAA
CGGAGTACAGACGTCTCAAGACTGAAACGGCCCCATTGCCTGGTCTAGTAGCGGATCTCACTCAGCCGCA
GACAAGTAATCACTAACCCGTTTTATTCTATTCCTATCTGTGGATGTGTAAATGGCTGGGGGCCAGCCC
TGGATAGGTTTTTATGGGAATTCTTTACAATAAACATAGCTTGTAACTTGAGATCTACAAATCCATTCAT
CCTGATTGGGCATGAAATCCATGGTCAAGAGGACAAGTGGAAAGTGAGAGGGAAGGTTTGCTAGACACCT
TCGCTTGTTATCTTGTCAAGATAGAAAAGATAGTATCATTTCACCCTTGCCAGTAAAAACCTTTCCATCC
ACCCATTCTCAGCAGACTCCAGTATTGGCACAGTCACTCACTGCCATTCTCACACTATAACAAGAAAAGA
AATGAAGTGCATAAGTCTCCTGGGAAAAGAACCTTAACCCCTTCTCGTGCCATGACTGGTGATTTCATGA
CTCATAAGCCCCTCCGTAGGCATCATTCAAGATCAATGGCCCATGCATGCTGTTTGCAGCAGTCAATTGA
GTTGAATTAGAATTCCAACCATACATTTTAAAGGTATTTGTGCTGTGTATATTTTGATAAAATGTTGT
GACTTCATGGCAAACAGGTGGATGTGTAAAAATGGAATAAAAAAAAAAAAAGAGTCAAAAAAAAAA

>gi|215422373|ref|NM_006403.3| Homo sapiens neural precursor cell expressed,
developmentally down-regulated 9 (NEDD9), transcript variant 1, mRNA
ACAACAGTGAGCTCAGAGACTTGAGGGAGGCGCTGCGACTGACAAGCGGCTCTGCCCGGGACCTTCTCGC

Figure 20 (Continued)

```
TTTCATCTAGCGCTGCACTCAATGGAGGGGCGGGCACCGCAGTGCTTAATGCTGTCTTAACTAGTGTAGG
AAAACGGCTCAACCCACCGCTGCCGAAATGAAGTATAAGAATCTTATGGCAAGGGCCTTATATGACAATG
TCCCAGAGTGTGCCGAGGAACTGGCCTTTCGCAAGGGAGACATCCTGACCGTCATAGAGCAGAACACAGG
GGGACTGGAAGGATGGTGGCTGTGCTCATTACACGGTCGGCAAGGCATTGTCCCAGGCAACCGGGTGAAG
CTTCTGATTGGTCCCATGCAGGAGACTGCCTCCAGTCACGAGCAGCCTGCCTCTGGACTGATGCAGCAGA
CCTTTGGCCAACAGAAGCTCTATCAAGTGCCAAACCCACAGGCTGCTCCCCGAGACACCATCTACCAAGT
GCCACCTTCCTACCAAAATCAGGGAATTTACCAAGTCCCCACTGGCCACGGCACCCAAGAACAAGAGGTA
TATCAGGTGCCACCATCAGTGCAGAGAAGCATTGGGGGAACCAGTGGGCCCCACGTGGGTAAAAAGGTGA
TAACCCCCGTGAGGACAGGCCATGGCTACGTATACGAGTACCCATCCAGATACCAAAAGGACGTCTATGA
TATCCCTCCTTCTCATACCACTCAAGGGGTATACGACATCCCTCCCTCATCAGCAAAAGGCCCTGTGTTT
TCAGTTCCAGTGGGAGAGATAAAACCTCAAGGGGTGTATGACATCCCGCCTACAAAAGGGGTATATGCCA
TTCCGCCCTCTGCTTGCCGGGATGAAGCAGGGCTTAGGGAAAAAGACTATGACTTCCCCCCTCCCATGAG
ACAAGCTGGAAGGCCGGACCTCAGACCGGAGGGGGTTTATGACATTCCTCCAACCTGCACCAAGCCAGCA
GGGAAGGACCTTCATGTAAAATACAACTGTGACATTCCAGGAGCTGCAGAACCGGTGGCTCGAAGGCACC
AGAGCCTGTCCCCGAATCACCCACCCCCGCAACTCGGACAGTCAGTGGGCTCTCAGAACGACGCATATGA
TGTCCCCCGAGGCGTTCAGTTTCTTGAGCCACCAGCAGAAACCAGTGAGAAAGCAAACCCCCAGGAAAGG
GATGGTGTTTATGATGTCCCTCTGCATAACCCGCCAGATGCTAAAGGCTCTCGGGACTTGGTGGATGGGA
TCAACCGATTGTCTTTCTCCAGTACAGGCAGCACCGGAGTAACATGTCCACGTCTTCCACCTCCTCCAA
GGAGTCCTCACTGTCAGCCTCCCCAGCTCAGGACAAAAGGCTCTTCCTGGATCCAGACACAGCTATTGAG
AGACTTCAGCGGCTCCAGCAGGCCCTTGAGATGGGTGTCTCCAGCCTAATGGCACTGGTCACTACCGACT
GGCGGTGTTACGGATATATGGAAAGACACATCAATGAAATACGCACAGCAGTGGACAAGGTGGAGCTGTT
CCTGAAGGAGTACCTCCACTTTGTCAAGGGAGCTGTTGCAAATGCTGCCTGCCTCCCGGAACTCATCCTC
CACAACAAGATGAAGCGGGAGCTGCAACGAGTTGAAGACTCCCACCAGATCCTGAGTCAAACCAGCCATG
ACTTAAATGAGTGCAGCTGGTCCCTGAATATCTTGGCCATCAACAAGCCCCAGAACAAGTGTGACGATCT
GGACCGGTTTGTGATGGTGGCAAAGACGGTGCCCGATGACGCCAAGCAGCTCACCACAACCATCAACACC
AACGCAGAGGCCCTCTTCAGACCCGGCCCTGGCAGCTTGCATCTGAAGAATGGGCCGGAGAGCATCATGA
ACTCAACGGAGTACCCACACGGTGGCTCCCAGGGACAGCTGCTGCATCCTGGTGACCACAAGGCCCAGGC
CCACAACAAGGCACTGCCCCCAGGCCTGAGCAAGGAGCAGGCCCCTGACTGTAGCAGCAGTGATGGTTCT
GAGAGGAGCTGGATGGATGACTACGATTACGTCCACCTACAGGGTAAGGAGGAGTTTGAGAGGCAACAGA
AAGAGCTATTGGAAAAAGAGAATATCATGAAACAGAACAAGATGCAGCTGGAACATCATCAGCTGAGCCA
GTTCCAGCTGTTGGAACAAGAGATTACAAAGCCCGTGGAGAATGACATCTCGAAGTGGAAGCCCTCTCAG
AGCCTACCCACCACAAACAGTGGCGTGAGTGCTCAGGATCGGCAGTTGCTGTGCTTCTACTATGACCAAT
GTGAGACCCATTTCATTTCCCTTCTCAACGCCATTGACGCACTCTTCAGTTGTGTCAGCTCAGCCCAGCC
CCCGCGAATCTTCGTGGCACACAGCAAGTTTGTCATCCTCAGTGCACACAAACTGGTGTTCATTGGAGAC
ACGCTGACACGGCAGGTGACTGCCCAGGACATTCGCAACAAAGTCATGAACTCCAGCAACCAGCTCTGCG
AGCAGCTCAAGACCATAGTCATGGCAACCAAGATGGCCGCCCTCCATTACCCCAGCACCACGGCCCTGCA
GGAAATGGTGCACCAAGTGACAGACCTTTCTAGAAATGCCCAGCTGTTCAAGCGCTCTTTGCTGGAGATG
GCAACGTTCTGAGAAGAAAAAAAAGAGGAAGGGACTGCGTTAACGGTTACTAAGGAAAACTGGAAATAC
TGTCTGGTTTTTGTAAATGTTATCTATTTTTGTAGATATTTATATAAAAATGAAATATTTTAACATTTT
ATGGGTCAGTCAACTTTCAGAAATTCAGGGAGCTGGAGAGGGAAATCTTTTTTTTTCCCCCTGAGTGGTT
CTTATGTATACATAGAAGTATCTGAGACATAAACTGTACAGAAAACTTGTCCACGTGCTTTTGTATGCCC
ATGTATTCATGTTTGTTTGTAGATGTTTGTCTGATGCATTTCATTAAAAAAAAAAACCATGAATTACGAAG
```

Figure 20 (Continued)

```
CACCTTAGTAAGCACCTTCTAATGCTGCATTTTTTTTGTTGTTGTTAAAAACATACCAGCTGGTTATAAT
ATTGTTCTCCACGTCCTTGTGATGATTCTGAGCCTGGCACTCCCAAATCTGGGAAGCATAGTTTATTTGC
AAGTGTTCACCTTCCAAATCATGAGGCATAGCATGACTTATTCTTGTTTGGAAAACTCTTTTCAAAACTG
ACCATCTTAAACACATGATGGCCAAGTGCCCAAAAGCCCTCTTGCGGAGCAAATTTCAGAATATATATGT
GGATCCAAGCTCTGATAGTTCAGGTGCTGGAGGGAAGAGAGACCTGTGTGTTTAGAGGCCAGGACCACAG
TTAGGATTGGGTTGTTTCAATACTGAGAGACAGCTACAATAAAAGGAGAGCAATTGCCTCCCTGGGGCTG
TTCAATCTTCTGCATTTGTGAGTGGTTCAGTCATGAGGTTTTCCAAAAGATGTTTTTAGAGTTGTAAAAA
CCATATTTGCAGCAAAGATTTACAAAGGCGTATCAGACTATGATTGTTCACCAAAATAGGGGAATGGTTT
GATCCGCCAGTTGCAAGTAGAGGCCTTTCTGACTCTTAATATTCACTTTGGTGCTACTACCCCCATTACC
TGAGGGAAACTGGCCAGGTCCTTGATCATGGAACTATAGAGCTACCAGGACATATCCTGCTCTCTAAGGG
AATTTATTGCTATCTTGCACCTTCTTTAAAACTCACATATGCAGACCTGACACTCAAGAGTGGCTAGCTA
CACAGAGTCCATCTAATTTTTGCAACTTCCTGTGGCCAGTGTGTATAACCCCTTCCACTATCTCACAGAT
AGTCACAGCGTCCATTCCATAGTCTGTCTCCTCACATCTGTTAGTATTGACACAGCACAGACACCACAAG
CCATCAGGTTCTTCATGGGGCAGGTGAAATACTTCTACCCCATGGGTAAATGTATTCACATATTACCAAG
AGAAGAAGCACATTATCTATGATCTTTTGGCCCAGTTCTTATTTAGCATTTTTATTCCAGCCTACTTGGA
AACATGTTTTTATTTGCAATATATGCCTGACTGAATTAAGCTTGCTTGTTTTAAACAACCAAATCATTGG
AACAGAAAAGGATTTAAAAAACAAGAATGCATGATCTCAGAGTGATTAAAAAAAAATCAGTGGAAATAAA
TGATCATAGAAGGTGCTTTTCAAAACAACTGCTATTATAATTCTCAAAGTCCTACTCTGCCAAAAGAAGA
TTAAAAGTCATACATTACATTACAAGGAAATGTTCATGTGGGAAGAGGGTTGCTGAAAATCAACAACGCT
TGAAGTTAAAAAGTGTGTCTTTGTAGATTTCATTGTATAATGTGTATTTCTTAGGAGATGGCTGACTTGA
TTGATCTACGCTAAGTGGAGACATTTCACATTTTTAAAACCAAATGTTCAATCTGTATTACTCTTTGCCG
TCTTGTATGTAGAGGCTATTTTTAAATCATTAAATTTTTAGATCTCTGTTTTCATAAAAAAAAAAAAAAA

>gi|282165678|ref|NM_006521.4| Homo sapiens transcription factor binding to IGHM
enhancer 3 (TFE3), mRNA
GGGGGAGGAGGGCGGTCGTCCGGGGTTAGGTTGAGGGGGGGCGTCGGTCCGTTCTGGGCGGGGATGACT
CACAGCCCATCCCATCTCCCAGACGCCGCCCGCCCGCGCAGTGCTAGCTCCATGGCTTAGCGGAGGAGGC
GGCAGTGGCGAGCTGGGGGAGGGGGGACTCTTATTTTGTTAGGGGGACCGGGCCGAGGCCCGACCGGCC
TGGCAGGGCTCGCCCGGGGCCGGGCGTCATGTCTCATGCGGCCGAACCAGCTCGGGATGGCGTAGAGGCC
AGCGCGGAGGGCCCTCGAGCCGTGTTCGTGCTGTTGGAGGAGCGCAGGCCGGCCGACTCGGCTCAGCTGC
TCAGCCTGAACTCTTTGCTTCCGGAATCCGGGATTGTTGCTGACATAGAATTAGAAAACGTCCTTGATCC
TGACAGCTTCTACGAGCTCAAAAGCCAACCCTTACCCCTTCGCTCAAGCCTCCCAATATCACTGCAGGCC
ACACCAGCCACCCCAGCTACACTCTCTGCATCGTCTTCTGCAGGGGGCTCCAGGACCCCTGCCATGTCGT
CATCTTCTTCATCGAGGGTCTTGCTGCGGCAGCAGCTAATGCGGGCCCAGGCGCAGGAGCAGGAGAGGCG
TGAGCGTCGGGAACAGGCCGCCGCGGCTCCCTTCCCCAGTCCTGCACCTGCCTCTCCTGCCATCTCTGTG
GTTGGCGTCTCTGCTGGGGCACACATTGAGCCGTCCACCCCCTGCTCAGGTGCCCAGGGAGGTGCTCA
AGGTGCAGACCCATCTGGAGAACCCAACGCGCTACCACCTGCAGCAGGCGCGCCGGCAGCAGGTGAAACA
GTACCTGTCCACCACACTCGGGCCCAAGCTGGCTTCCCAGGCCCTCACCCCACCGCCGGGGCCCGCAAGT
GCCCAGCCACTGCCTGCCCCTGAGGCTGCCCACACTACCGGCCCACAGGCAGTGCGCCCAACAGCCCCA
TGGCGCTGCTCACCATCGGGTCCAGCTCAGAGAAGGAGATTGATGATGTCATTGATGAGATCATCAGCCT
GGAGTCCAGTTACAATGATGAAATGCTCAGCTATCTGCCCGGAGGCACCACAGGACTGCAGCTCCCCAGC
ACGCTGCCTGTGTCAGGGAATCTGCTTGATGTGTACAGTAGTCAAGGCGTGGCCACACCAGCCATCACTG
```

Figure 20 (Continued)

```
TCAGCAACTCCTGCCCAGCTGAGCTGCCCAACATCAAACGGGAGATCTCTGAGACCGAGGCAAAGGCCCT
TTTGAAGGAACGGCAGAAGAAAGACAATCACAACCTAATTGAGCGTCGCAGGCGATTCAACATTAACGAC
AGGATCAAGGAACTGGGCACTCTCATCCCTAAGTCCAGTGACCCGGAGATGCGCTGGAACAAGGGCACCA
TCCTGAAGGCCTCTGTGGATTATATCCGCAAGCTGCAGAAGGAGCAGCAGCGCTCCAAAGACCTGGAGAG
CCGGCAGCGATCCCTGGAGCAGGCCAACCGCAGCCTGCAGCTCCGAATTCAGGAACTAGAACTGCAGGCC
CAGATCCATGGCCTGCCAGTACCTCCCACTCCAGGGCTGCTTTCCTTGGCCACGACTTCGGCTTCTGACA
GCCTCAAGCCAGAGCAGCTGGACATTGAGGAGGAGGGCAGGCCAGGCGCAGCAACGTTCCATGTAGGGGG
GGGACCTGCCCAGAATGCTCCCCATCAGCAGCCCCTGCACCGCCCTCAGATGCCCTTCTGGACCTGCAC
TTTCCCAGCGACCACCTGGGGGACCTGGGAGACCCCTTCCACCTGGGGCTGGAGGACATTCTGATGGAGG
AGGAGGAGGGGTGGTGGAGGACTGTCGGGGGGTGCCCTGTCCCACTGCGGGCTGCCTCCGATCCCCT
GCTCTCTTCAGTGTCCCCTGCTGTCTCCAAGGCCAGCAGCCGCCGCAGCAGCTTCAGCATGGAAGAGGAG
TCCTGATCAGGCCTCACCCCTCCCCTGGGACTTTCCCACCCAGGAAAGGAGGACCAGTCAGGATGAGGCC
CCGCCTTTTCCCCCACCCTCCCATGAGACTGCCCTGCCCAGGTATCCTGGGGGAAGAGGAGATGTGATCA
GGCCCCACCCCTGTAATCAGGCAAGGAGGAGGAGTCAGATGAGGCCCTGCACCTTCCCCAAAGGAACCGC
CCAGTGCAGGTATTTCAGAAGGAGAAGGCTGGAGAAGGACATGAGATCAGGGCCTGCCCCCTGGGGATCA
CAGCCTCACCCCTGCCCCTGTGGGACTCATCCTTGCCCAGGTGAGGGAAGGAGACAGGATGAGGTCTCGA
CCCTGTCCCCTAGGGACTGTCCTAGCCAGGTCTCCTGGGAAAGGGAGATGTCAGGATGTTGCTCCATCCT
TTGTCTTGGAACCACCAGTCTAGTCCGTCCTGGCACAGAAGAGGAGTCAAGTAATGGAGGTCCCAGCCCT
GGGGGTTTAAGCTCTGCCCCTTCCCCATGAACCCTGCCCTGCTCTGCCCAGGCAAGGAACAGAAGTGAGG
ATGAGACCCAGCCCCTTCCCCTGGGAACTCTCCTGGCCTTCTAGGAATGGAGGAGCCAGGCCCCACCCCT
TCCCTATAGGAACAGCCCAGCACAGGTATTTCAGGTGTGAAAGAATCAGTAGGACCAGGCCACCGCTAGT
GCTTGTGGAGATCACAGCCCCACCCTTGTCCCTCAGCAACATCCCATCTAAGCATTCCACACTGCAGGGA
GGAGTGGTACTTAAGCTCCCCTGCCTTAACCTGGACCAACCTGACCTAACCTAGGAGGGCTCTGAGCCA
ACCTTGCTCTTGGGGAAGGGGACAGATTATGAAATTTCATGGATGAATTTTCCAGACCTATATCTGGAGT
GAGAGGCCCCCACCCTTGGGCAGAGTCCTGCCTTCTTCCTTGAGGGGCAGTTTGGGAAGGTGATGGGTAT
TAGTGGGGACTGAGTTCAGGTTACCAGAACCAGTACCTCAGTATTCTTTTTCAACATGTAGGGCAAGAG
GATGAAGGAAGGGGCTATCCTGGGACCTCCCCAGCCCAGGAAAAACTGGAAGCCTTCCCCCAGCAAGGCA
GAAGCTTGGAGGAGGGTTGTAAAAGCATATTGTACCCCCTCATTTGTTTATCTGATTTTTTTATTGCTCC
GCATACTGAGAATCTAGGCCACCCCAACCTCTGTTCCCCACCCAGTTCTTCATTTGGAGGAATCACCCCA
TTTCAGAGTTATCAAGAGACACTCCCCCCTCCATTCCCACCCCTCATACCTACACCCAAGGTTGTCAGCT
TTGGATTGCTGGGCCAGGCCCCATGGAGGGTATACTGAGGGGTCTATAGGTTTGTGATTAAAATAATAA
AAGCTAGGCGTGTTTGATGCGCTTTTAACTTTGAAAAAAAAAAAAAAAAAAAAAAAAAAAAAAAAAAAAA
A
```

>gi|54112115|ref|NM_006802.2| Homo sapiens splicing factor 3a, subunit 3, 60kDa (SF3A3), mRNA
```
TTCCGGCACTCGCGGAACTTTGGTGCAGCCTGATGCGCAACGTGGGGACTCAGGCGCGCTGGGCGGCAGG
AGTTGCTTCCGGCCGTGTTGGTGGTCTGAATTGAGAAGCCGCGACTAAGGGAAGATGGAGACAATACTGG
AGCAGCAGCGGCGCTATCATGAGGAGAAGGAACGGCTCATGGACGTCATGGCTAAAGAGATGCTCACCAA
GAAGTCCACGCTCCGGGACCAGATCAATTCTGATCACCGCACTCGGGCCATGCAAGATAGGTATATGGAG
GTCAGTGGGAACCTGAGGGATTTGTATGATGATAAGGATGGATTACGAAAGGAGGAGCTCAATGCCATTT
CAGGACCCAATGAGTTTGCTGAATTCTATAATAGACTCAAGCAAATAAAGGAATTCCACCGGAAGCACCC
```

Figure 20 (Continued)

```
AAATGAGATCTGTGTGCCAATGTCAGTGGAATTTGAGGAACTCCTGAAGGCTCGAGAGAATCCAAGTGAA
GAGGCACAAAACTTGGTGGAGTTCACAGATGAAGAGGGATATGGTCGTTATCTCGATCTCCATGACTGTT
ACCTCAAGTACATTAACCTGAAGGCATCTGAGAAGCTGGATTATATCACATACCTGTCCATCTTTGACCA
ATTATTTGACATTCCTAAAGAAAGGAAGAATGCAGAGTATAAGAGATACCTAGAGATGCTGCTTGAGTAC
CTTCAGGATTACACAGATAGAGTGAAGCCTCTCCAAGATCAGAATGAACTTTTTGGGAAGATTCAGGCTG
AGTTTGAGAAGAAATGGGAGAATGGGACCTTTCCTGGATGGCCGAAAGAGACAAGCAGTGCCCTGACCCA
TGCTGGAGCCCATCTTGACCTCTCTGCATTCTCCTCCTGGGAGGAGTTGGCTTCTCTGGGTTTGGACAGA
TTGAAATCTGCTCTCTTAGCTTTAGGCTTGAAATGTGGCGGGACCCTAGAAGAGCGAGCCCAGAGACTAT
TCAGTACCAAAGGAAAGTCCCTGGAGTCACTTGATACCTCTTTGTTTGCCAAAAATCCCAAGTCAAAGGG
CACCAAGCGAGACACTGAAAGGAACAAAGACATTGCTTTTCTAGAAGCCCAGATCTATGAATATGTAGAG
ATTCTCGGGGAACAGCGACATCTCACTCATGAAAATGTACAGCGCAAGCAAGCCAGGACAGGAGAAGAGC
GAGAAGAAGAGGAAGAAGAGCAGATCAGTGAGAGTGAGAGTGAAGATGAAGAGAACGAGATCATTTACAA
CCCCAAAAACCTGCCACTTGGCTGGGATGGCAAACCTATTCCCTACTGGCTGTATAAGCTTCATGGCCTA
AATATCAACTACAACTGTGAGATTTGTGGAAACTACACCTACCGAGGGCCCAAAGCCTTCCAGCGACACT
TTGCTGAATGGCGTCATGCTCATGGCATGAGGTGTTTGGGCATCCCAAACACTGCTCACTTTGCTAATGT
GACACAGATTGAAGATGCTGTCTCCTTGTGGGCCAAACTGAAATTGCAGAAGGCTTCAGAACGATGGCAG
CCTGACACTGAGGAAGAATATGAAGACTCAAGTGGGAATGTTGTGAATAAGAAGACATACGAGGATCTGA
AAAGACAAGGACTGCTCTAGTGTTCAGGGATGTAGCTCAGCTTTTGGGCTAGCCCAGGCTTCCCTAAGAT
CTGCTTTTTCTATTTCTCCCAACCAAATCCTCTTAAAGACCCTTTGCTATGTAGTCTCATGGTCTAGCAT
GCATCTTGTAGAAACAAGGCATGCTGGCAGATTGCAGGGTTGAGATGTGTTTTATCTGTTTTATATTTTA
AAAGATTCTGCCAGAAAATAAAACCAGACCTTGTTCTAAAGCCCAGGGTTATGGACCAACTCAGTGCTTC
AGGTCTTAACGCCTCCATACCTCTTCCTCACCAACTTTACTAGTAGCTGAGATTTAATGGGCACCTATTA
TGCTACATATCATGTTAGGTAAATCTGACCTGACCTCTTTCCCCACCCTCCTTTGTTGCTGCTTCCCTGA
ATGAGTATTACCCCAGGATGAGGTCTGCCATCAGCTTAGTTAGCCATTGATGCAAATACTAGGGAAAGAC
TAGGAGGATGAGCCAGGGTTGCTACTAAGGACTAAGTGTCGCACCAAGGTTTGCCTTTTGTATTTGCATA
AAGAAAGGAGTTGGAGCTGGGTGCAGTGGCTTGTGCCTGTAGTCCCAGCTACTTGGGAGGCTGAGGCAGG
AGGGTTGCTTGAGACTAGCCTAGGTAACATAGTGAGACCCTGTCTCATTAAAAAAAAAAAAAAGGCATGG
TGGCACGCACTGTAGTCCCAGCTACTCAGGAGACTGAGGCTAGAAGATCCTTTGAACCTAGGAGTTTGAG
ACCAGCCTGGGCGATATAGTGAGGCCCCATCTCAAAAAAAAAAAAAGGGGGGGGGGGGGAGTTGGGCTG
TGTTGGAATGGGCCTGCAGCCCAACAAACAAGGGAACTAGGACCGACAGTGACTTCACCAGCTTGCTAGG
TCAGAATGAGAGACTGGTGGGTCTGTCTACCTGTTTCTTCTACAAGATCCCTATTTGACTGTAAAAGTAG
CTAATACTCACATGTTCTCCAATCCCAGGTAGCCATGGTAGAGTTGGGTAGAGTTGAGCAGCTGCCCCAG
GATCCAAATGTGGTGTCTGAAATGGAAAGAACTAAGGCAACCAGGAAGGCACTGATCTGCCTTATAAGCA
CAGTCATCTGAAAGTCAGGCCTGCTGCAGGACAGGATCCCCCAGAGACCCCATTTGCCTCTCAACACTCA
GACCTTCAACTGTTTTTTAATAAATCTACTTTTTAAAAAAAAAAAAAAAAAAAAA

>gi|142377168|ref|NM_014077.2| Homo sapiens family with sequence similarity 32,
member A (FAM32A), mRNA
CGAAGCACTGGAGAGTGTCATGGAGGCCTACGAGCAGGTCCAAAAGGGACCCCTGAAGCTGAAAGGCGTC
GCAGAGCTGGGAGTGACCAAGCGGAAGAAGAAAAAGAAGGACAAAGACAAAGCGAAACTCCTGGAAGCAA
TGGGAACGAGCAAAAAGAACGAGGAGGAGAAGCGGCGCGGCCTGGACAAGCGGACCCCGGCCCAGGCGGC
CTTCGAGAAAATGCAGGAGAAGCGGCAAATGGAAAGGATCCTAAAGAAGGCATCCAAAACCCACAAGCAG
```

Figure 20 (Continued)

```
AGAGTGGAGGACTTCAACAGACACCTGGACACACTCACGGAGCATTACGACATTCCCAAAGTCAGCTGGA
CGAAGTAGCCGCCTGCCCCCAGTATGGAGCAGCATCGAGGGTTCGCAAAAGGCCACACTGGGGTTGTGTG
TGTTTCCTTTGGTATATTCTGGAAACATGGCTACACACACCCTTGCATCTTCTGCTACAGACTGCTTTTC
GAAGCTGTGTACCCTCATTCTGGAACTTGATTAAAGTAAGATCGTCCTTGTACTCAGTTTAGGCTTCTTG
GCAACATACAGAAGATACACCCTTTTCGTTTGGATGGAAAGTTTCTAAGTTTATCCAGAGGTAAAGCCCA
TTGTGTGTCTGTGTCATGTAAAAATGTTTTCACCCGAGTTGCATGTAATGCTCTGAGGCCAGCCAGCTGT
CTTCTCCTGGATGAGACAGACTCCAGAGGGTAAGGAGCTAGCGCCATGGTGGCCTGCAGTATGCAGAGCC
CCGCAGGACCCAGCGTGGGCGCCCTTCCAAGCTTCCTCTAGCTTTGGGCCTATGCTGTCCCCTGCAGGCC
CTAGGGAAGCCACTTGCAACTATGCGGCCTTCAGACTTCCTCCTCAGCCACCTGGCCACTGAGACAGCAT
AGCCTGGGTAACGGAACAGCCACCTAAGGCAAGAATGGAACGGACACACCTTGCTCCTTTCTGAGCCCGT
TTCCCAAAACCCCCCTTCCAGGTGCTTCTAATGGGTGTTGCCATAGCAGACGCTGCTAATGCATCACAGC
ATTCTTTGAAATGGAACCAGACACAGCCTGCCTCTCAATCCTCAGCTGGGGGCTCCTAGCAGCCTCTTGT
ATTTACTCAGAGTTGACACATCACACAGATCCTGTTTGGCATTCCTACCTTACGGACGTCTCAGGGGTGA
CAGGACCAGGGCAGAGCCCCGGTACAAACAGACAAGGCTGCAGTCAAATGGGAGGGTCCAGGTGTCCGTG
TTGGAGGGCTGGGATCTTGTAGGGCCTGTGCGTCCTGGCTGAGGATCAAACCACATATGTTATTGGGAGA
AACGATTTCTGTTGACGTAGATATTGAAAGAATAATGAAGGCAGAAGAGAAAAACGAAGTGTGGAATTTG
GGGTTGTCCTGTGTAAATTACACAATAAAGCAAAAGTCAGTTATTGTAAAAAAAAAAAAAAAAA

>gi|315360640|ref|NM_014215.2| Homo sapiens insulin receptor-related receptor
(INSRR), mRNA
TTTCTCCCTCTGGAGGCCCGAGACTCTCCCTGTCACTGTCTGCATCTCTGTCCCCATCTCTCAATCTCAT
GCTGAGTCTCTCTGTCTCCAACTGCCTGTCACTGTCTTTGTGTCTCTGTGACTCTCATTTCTTTTTTTCT
GTCTCCTGCTGTCTCTGTGTGGGATTCCTTGTCTCTCTGCCCCTGCCCTCCCTCTCCTATCTGAACCCTG
GTCTCTGTGTCCCTTAGGGCTTATCACACCGTTCTCCCCAGAGTCACCGGGAGGAGAGCCGGGACTGGAC
ACAAGCCAGGGCTGGGACAATGGCAGTGCCTAGTCTGTGGCCCTGGGGAGCATGCCTGCCTGTGATCTTC
CTCTCCTTGGGATTTGGCCTGGATACAGTAGAGGTGTGCCCCAGCCTGGATATTCGCTCAGAGGTGGCAG
AGCTTCGTCAGCTGGAGAACTGCAGCGTGGTGGAGGGCCACCTGCAGATCCTGCTCATGTTCACAGCCAC
CGGGGAGGACTTCCGCGGCCTCAGCTTCCCTCGCCTCACCCAGGTCACCGACTACCTGCTGCTCTTCCGT
GTCTACGGACTGGAGAGCCTGCGCGACCTCTTCCCCAACCTAGCAGTCATCCGCGGGACGCGCCTCTTCC
TGGGCTATGCACTGGTCATCTTTGAGATGCCACATCTGCGTGACGTGGCACTGCCTGCACTTGGGGCCGT
GCTGCGTGGGCTGTGCGTGTGGAGAAGAACCAGGAGCTCTGCCACCTCTCCACCATTGACTGGGGACTG
CTGCAGCCAGCACCTGGCGCCAACCACATCGTGGGCAACAAGCTGGGCGAGGAGTGTGCTGACGTGTGCC
CTGGTGTGCTGGGTGCTGCTGGTGAGCCCTGTGCCAAGACCACCTTCAGCGGGCACACTGACTACAGATG
CTGGACCTCCAGCCACTGCCAGAGAGTGTGCCCCTGCCCCATGGGATGGCTTGCACAGCGAGGGGCGAG
TGCTGCCACACCGAATGCCTGGGGGGCTGCAGCCAGCCAGAAGACCTCGTGCCTGTGTAGCTTGCCGCC
ACCTCTACTTCCAGGGTGCCTGCCTGTGGGCCTGCCCGCCAGGCACCTACCAGTATGAGTCCTGGCGCTG
TGTCACAGCTGAGCGCTGTGCCAGCCTGCACTCTGTGCCCGGCCGTGCCTCCACCTTCGGCATACACCAG
GGCAGTTGCCTGGCCCAGTGCCCTTCTGGCTTCACCCGTAATAGCAGCAGCATATTCTGCCACAAGTGCG
AGGGGCTGTGCCCTAAAGAGTGCAAGGTAGGCACCAAGACCATCGACTCCATCCAGGCGGCACAGGATCT
TGTGGGCTGCACGCATGTGGAGGGAAGCCTCATCCTCAACCTTCGCCAGGGCTACAACCTGGAGCCACAG
CTGCAGCACAGCCTGGGGCTGGTAGAAACCATTACTGGCTTCCTCAAAATCAAGCACTCCTTTGCCCTCG
TGTCCCTGGGCTTTTTCAAGAACCTCAAACTAATCCGGGGAGACGCCATGGTGGATGGGAACTACACTCT
```

Figure 20 (Continued)

```
CTACGTGCTGGACAACCAGAACCTACAACAGCTAGGGTCCTGGGTGGCCGCGGGGCTCACCATTCCCGTG
GGCAAGATCTACTTCGCCTTCAACCCGCGCCTCTGCTTGGAACACATCTACCGACTGGAGGAGGTGACAG
GCACGCGAGGTCGGCAGAACAAGGCTGAGATCAACCCCCGCACCAACGGAGACCGCGCCGCCTGCCAGAC
TCGCACCCTGCGCTTCGTGTCCAACGTGACGGAGGCAGACCGCATCCTGCTACGCTGGGAGCGCTATGAG
CCACTGGAGGCCCGCGACCTGCTCAGCTTCATCGTGTACTACAAGGAGTCCCCATTCCAGAACGCCACAG
AGCACGTGGGTCCAGATGCTTGTGGAACCCAGAGCTGGAACCTGCTGGATGTGGAGCTGCCCCTAAGCCG
CACCCAGGAGCCAGGGGTGACCCTAGCCTCCCTCAAGCCTTGGACACAGTACGCAGTGTTTGTGCGGGCC
ATCACGCTAACCACTGAGGAGGACAGCCCTCATCAAGGAGCCCAGAGTCCCATCGTCTACCTCCGAACGC
TGCCTGCAGCTCCCACGGTGCCCCAAGACGTCATCTCCACGTCCAACTCCTCCTCCCACCTCCTGGTGCG
CTGGAAGCCACCGACCCAGCGCAATGGGAACCTCACCTACTACCTGGTGCTGTGGCAGCGGCTGGCAGAG
GACGGCGACCTCTACCTCAATGACTACTGCCACCGCGGCTTGCGGCTGCCCACCAGCAACAACGATCCGC
GCTTCGACGGCGAAGACGGGGATCCTGAGGCCGAGATGGAGTCCGACTGCTGCCCTTGCCAGCACCCACC
TCCTGGTCAGGTTCTGCCCCCGCTGGAGGCGCAAGAGGCCTCGTTCCAGAAGAAGTTTGAAAACTTTCTA
CACAACGCGATCACCATCCCCATATCCCCTTGGAAGGTGACGTCCATCAACAAGAGCCCCCAAAGGGACT
CAGGGCGGCACCGCCGGGCAGCTGGGCCCCTCCGGCTGGGGGGCAACAGCTCGGATTTCGAGATCCAGGA
GGACAAGGTGCCCCGTGAGCGAGCGGTGCTGAGCGGCCTGCGCCACTTCACGGAATACCGGATCGACATC
CATGCCTGCAACCACGCGGCGCACACCGTGGGCTGCAGCGCCGCCACCTTCGTCTTTGCGCGCACCATGC
CCCACAGAGAGGCTGATGGTATTCCAGGAAAGGTGGCCTGGGAGGCCTCCAGCAAGAACAGTGTCCTTCT
GCGCTGGCTCGAGCCACCAGACCCCAACGGACTCATCCTCAAGTACGAAATCAAGTACCGCCGCTTGGGA
GAGGAGGCCACAGTGCTGTGTGTGTCCCGTCTTCGATATGCGAAGTTTGGGGGAGTCCACCTGGCCCTGC
TGCCCCCTGGAAACTACTCTGCCAGGGTTAGGGCAACCTCACTGGCTGGCAATGGCTCTTGGACAGACAG
TGTTGCCTTCTACATCCTTGGCCCAGAGGAGGAGGATGCTGGGGGGCTGCATGTCCTCCTCACTGCCACC
CCTGTGGGGCTCACGCTGCTCATCGTTCTTGCTGCCCTTGGTTTCTTCTACGGCAAGAAGAGAAACAGAA
CCCTGTATGCTTCTGTGAATCCAGAGTACTTCAGCGCCTCTGATATGTATGTCCCTGATGAATGGGAGGT
GCCTCGGGAGCAGATCTCGATAATCCGGGAACTGGGCCAGGGCTCTTTTGGGATGGTATATGAGGGGCTG
GCACGAGGACTTGAGGCTGGAGAGGAGTCCACACCCGTGGCCCTGAAGACGGTGAATGAGCTGGCCAGCC
CACGGGAATGCATTGAGTTCCTCAAGGAAGCTTCTGTCATGAAAGCCTTCAAGTGTCACCATGTGGTGCG
TCTCCTGGGTGTGGTATCTCAGGGCCAGCCAACTCTGGTCATCATGGAGTTAATGACCCGTGGGGACCTC
AAGAGCCATCTTCGATCTTTGCGGCCTGAGGCAGAGAACAACCCTGGGCTCCCACAGCCAGCATTGGGGG
AAATGATCCAAATGGCTGGTGAGATTGCAGACGGCATGGCCTACCTTGCTGCCAACAAGTTTGTGCACCG
AGATCTAGCAGCCCGCAACTGCATGGTGTCCCAGGACTTCACCGTCAAGATCGGGGACTTCGGGATGACT
CGGGACGTGTATGAGACAGACTATTACCGCAAGGGTGGGAAGGGGCTGCTGCCCGTGCGCTGGATGGCCC
CCGAGTCCCTCAAAGATGGGATCTTCACCACCCACTCGGATGTCTGGTCCTTTGGCGTGGTACTCTGGGA
GATTGTGACCCTGGCAGAACAACCCTACCAGGGCCTGTCCAATGAGCAGGTGCTGAAGTTCGTCATGGAT
GGCGGGGTCCTGGAGGAGCTGGAGGGCTGTCCCCTTCAGCTGCAGGAGCTGATGAGCCGCTGCTGGCAGC
CGAACCCACGCCTGCGCCCATCTTTCACACACATTCTGGACAGCATACAGGAGGAGCTGCGGCCCTCCTT
CCGCCTCCTCTCCTTCTACTACAGCCCGGAATGCCGGGGGCCCGGGGCTCCCTGCCTACCACCGATGCA
GAGCCTGACTCCTCACCCACTCCAAGAGACTGCAGCCCTCAAAATGGGGGTCCAGGGCACTGA
```

>gi|111378389|ref|NM_014240.2| Homo sapiens LIM domains containing 1 (LIMD1), mRNA
ACACACACACACACGGCACCTGGGCTAGGCCCGGACACCTGTCTGCAGCATGGATAAGTATGACGACCTG

Figure 20 (Continued)

```
GGCCTGGAGGCCAGTAAATTCATCGAGGACCTGAACATGTATGAGGCCTCTAAGGATGGGCTCTTCCGAG
TGGACAAGGGTGCAGGCAACAACCCCGAGTTTGAGGAAACTCGCAGGGTGTTCGCCACCAAGATGGCCAA
AATCCACCTCCAGCAGCAGCAGCAGCAGCTCCTGCAGGAGGAGACTCTGCCCAGGGGAGTAGAGGCCCT
GTCAATGGAGGGGCCGCCTGGGCCCACAGGCCCGTTGGGAAGTTGTGGGCAGCAAGCTGACTGTGGATG
GTGCTGCCAAGCCTCCTCTTGCTGCCTCGACAGGGGCACCTGGGGCAGTCACCACCCTCGCTGCTGGGCA
GCCCCCGTACCCACCGCAGGAGCAGAGATCCAGGCCATACCTGCATGGCACGAGGCATGGCAGCCAGGAC
TGTGGTTCCAGGGAGAGCCTGGCGACTTCTGAGATGTCTGCTTTCCACCAGCCAGGCCCCTGTGAGGATC
CTTCCTGCCTCACTCATGGAGACTATTATGACAACCTCTCCTTGGCAAGCCCAAAGTGGGGTGACAAACC
AGGAGTGTCCCCCAGCATCGGCCTGAGTGTAGGGAGTGGGTGGCCTAGCTCCCCGGGGAGTGACCCACCA
CTGCCCAAACCCTGCGGGGACCATCCCCTAAATCACCGACAGCTCTCCCTGAGCTCCAGCAGGTCTTCTG
AGGGTAGCCTCGGTGGTCAGAATAGTGGCATTGGTGGCCGCAGCAGCGAGAAGCCAACAGGCCTTTGGTC
CACTGCCTCCTCCCAGCGGGTGAGCCCTGGCCTGCCTTCCCCAAACTTGGAGAACGGAGCACCAGCTGTG
GGGCCTGTTCAGCCCAGGACCCCTTCTGTGTCAGCACCCTTGGCCCTGAGCTGCCCCAGGCAAGGAGGTC
TTCCAAGATCAAACTCGGGGCTGGGGGGTGAGGTTTCAGGTGTGATGTCCAAACCCAATGTGGACCCCCA
ACCCTGGTTCCAGGATGGGCCCAAATCTTACCTTTCCAGTTCTGCCCCGTCATCCTCGCCAGCTGGTCTG
GACGGTTCACAGCAGGGTGCGGTCCCTGGGCTGGGGCCGAAGCCTGGCTGCACAGACCTTGGCACTGGTC
CCAAGCTCAGCCCCACCAGTCTTGTCCATCCAGTGATGTCCACCCTGCCTGAGTTATCTTGTAAAGAGGG
TCCCCTGGGCTGGTCTTCTGATGGTAGCCTGGGATCTGTGCTCCTGGACAGCCCCAGCTCCCCTAGGGTA
AGGCTGCCCTGCCAGCCCCTCGTCCCAGGTCCTGAGCTGAGACCCTCTGCTGCTGAGTTGAAATTAGAAG
CCCTCACCCAACGTCTGGAGCGAGAGATGGATGCTCACCCGAAGGCTGATTACTTTGGAGCCTGTGTGAA
ATGCAGCAAAGGGGTGTTTGGGGCTGGCCAGGCCTGTCAGGCCATGGGGAACCTCTACCATGACACATGC
TTCACCTGTGCAGCTTGCAGCCGGAAGCTGAGAGGAAAAGCCTTTTATTTTGTCAACGGCAAAGTGTTTT
GTGAAGAAGACTTCCTGTACTCTGGTTTCCAGCAGTCGGCTGACAGGTGTTTTCTTTGTGGACATCTGAT
CATGGACATGATCCTGCAAGCCCTGGGGAAGTCCTACCACCCCGGCTGTTTCCGCTGTGTCATCTGTAAT
GAGTGTTTGGATGGGGTGCCCTTCACCGTGGACTCAGAGAACAAGATCTACTGTGTCCGAGATTACCACA
AGGTGCTGGCCCCCAAGTGTGCAGCCTGTGGGCTTCCCATCCTTCCACCTGAGGGCTCAGATGAGACCAT
CCGTGTCGTGTCCATGGACAGAGACTACCACGTGGAGTGTTACCACTGCGAGGACTGTGGTCTGGAGCTC
AATGATGAAGATGGCCACCGCTGTTATCCGCTGGAGGACCACCTGTTCTGTCACTCCTGCCACGTGAAGA
GGCTGGAGAAGAGACCCTCATCTACAGCCCTTCACCAGCACCACTTCTAGCCAGAGCCACTTGCAGACAT
CACGGCAGGGGATGAGGAGCCGGGGTTGCTGCTGCTGCTTCCGGTGGCCCCTGGGGTGGAAGTGGGGTAG
GGGAAGAGGAGGGGCAGGAGGGAGAGTTCCTGTGAGCATGTGGGGGGTGCCTTTCCTTTAACCAGGGAGG
TGAACACTACCTGCCTCCTGCGTGTATTTTCCAAGTGCTTTTCTCTGTTGCCACATTTTCCTCAGGTTAC
TCAGGAAAATGCTCCAGCATGTGCGAGCACATGACCTGAGGTTGCATCATAGCACCAAAGGAATCCTCCT
GTCCCCTCTGGGAACATTTCATGCTTCAGAGGGAGAGGTTTTTATTGAGCTTGTTTCACAATATCCCCTT
GAAGGGACAGCTCAGCTGCCAATACATTCAACCCTTTCTCTTCCTTCAGGAAAATACCTATACCCAAATG
TTCCCTCCCCCGACATATATCATGGCATGATTTAAGGCTTCTTTTCACCTGAGAGCTTCAGTTCTTCTGC
AGAATGGCTGCAAATTTAATTGCATTAAGGCAAGAAGGAAGCTCTAATGTGTGCTTTGTATCCTAAGATA
AATTTGCTTAGAAAACCAGAGTCAAGATTTGAAATAGGTGAGGCAGGGTTTCCTCCTTAGACACTGACAG
CATTCTCTGTACCCCTTCAAATCCTTACTCTCCTAAAGGCAGCTGAGTCCGCGACAGAAATTTGCCCTAT
GTGAGTAAAACATACTTTGGGAGAAGAACTTGGTGCAGGCACCAGGATTTTTTTTTTGCCCACGTGTTT
GCGCTGTTTTTCTCTGGAGTTCTCAAGAGTTGGTGACTTGGAAGGCCGCTTCTGCAAGGCAAGTCTCAGG
AACCCATGCAGGTACATCGCTTGCACCTGTTTTTAGCTTATTTAATGACGGGCTTTTGGGAAGAGCTGCC
```

Figure 20 (Continued)

```
CGCATACTGAGAGACAGCTTCTTATAAACAAGGAGAGTTTTTGTGTGTGCGAGATCTCTAAGCCAGCGTG
GGAGGGAGCGCCTCAGGATAAGTTATTATATTCATTTCGTTGGTTTCTCTCCTGCCCAATTCTTGGCACA
GGCATTATGTTTGAAGAAACCAGGATAAGGTACACTGCTTTTGTCTGTTTAATTTTTTTAGTTGTTTCCC
TTCACTTTCAGTCTTCCACACACAAAAAATACCTCACAGAGCTTCACCAAATCACAGATTCAGGAGGAAT
TTGGCTTTCACACTGGACTCAGATACCTTCTTCAGTGTGTTGGAAATCACTGGCTTCACACAGGCCCAAC
TCCAGCTGGTCAGGGCAGAGTGATCGTAACTAAAGGTCAGTGGGGAATAGATCCGATTCAGTGCTTTTGC
CTTATGCATTTCAGCATCCTGGCTCCCCAGGGTGGCAGGAGCTGAGGGAGGGCCACACACTGGCAAGATT
TCAAGACCACTCTCTGCACTGAAGAGGTAAAATTTGCACTGCAAGTCACATCCCTGAGGCCAGAGGTCAG
TACCCTTTGGTATTTCGATTAGAAGAAGCTGCAAAAGAAAGGCAGCCCATTTTACCATTGCCAGCCAGGC
CGGGGACACAGGAGCCGGTGTGTGCACTCTGCCTCCTCACCTTGCACCCAGAGCAAGAGGACTGGGTGCT
GGGCTGCAGAGGCCGGTCAGTGGAGCCCCTAGCACGTGTGAACTCAGGCTTTTCATTGGGCCCGGCTCCA
CTTCTAGGCCATGTTTTGACTCATTTGGTAACCATTGCCTGTAAGCAGCACAGAATTGGTGCCATGGATT
ATCTTTTCCATGTTGATGGAATTCATTCTGTTGGAATCCTTTGGCCAGATGTCACTTCAGCCAGGGTGTG
CATCATCATTGGTTCTTTTTCACAGGCTGAGCCTCCTGAAAACCCATGAACGCTGGGGCTGGGGAAGTGA
ACCCTGAGGTGGGGACCCTCTCTTCCCATCAAATCATCCAGCTCAGTGTGGGGCGTGGCAGGGGGGTAAA
TGAAGCCAGCCAATGTGTTAACCTGTCTCTGTCAACCTAAGAATGTTGGCCTTACTGACACACCTTTGCT
CCATGTTCAAGACCAGAAGTAGCTGGGATTTGTTTGCAAATTGGGTAATTAGTTTAAAAATCTGTGATTA
CATTTTTAAATGAAATTTTCAAAGTGGCCTAGATTGAGGTGATTCAGATAGGTTTGCGAATATACCATTT
TATATTGTTGAGAAAGAACAAAAAGGGAATTTCCAGATGTCCTAGAAATCCTAGCAACAGATTTCTCTGG
TTGTCAGTTTCCCTGGAGAAGGCGCCAGATAGGAATCTCCAATCAGTTGTTTTTCTCTTCGCTTCAGGCC
CTTACACAAAAGCCATGAAGAGATGTTCACCTACCCGGTATTTTAAATGTTCTGTAAATTATTAGCCAAA
TAGAACTGTAATGGGGTTGTATTTATGGGCGCCTAGAAAGAAAACACAAGGACTTGGTAGGCCAGGAAGA
AAAGATTTTAAAATTTAGAATGAATAGCCCTTCTGGGTTTTCTTTTTGACAATTCTTGGACTTGAGGTAA
AACAAGGAGGATTGTGGCCGGATTTCAGATCCCAAAGCCAGCCTCCATCTTAGGCCTTTGCCTCATTGTG
CCTTTTAGGTTTTCTTACCCACCGTCTCCTGTTTTGTCTTTTTTTCTTTTCTCCTACCCCTATCTTGGG
ACATTCAGAAACTGCCTGGGTGGTTTGAGAAGAGACAACCCAGTTTGATCTGCAATACAAGGATCCATTC
GTAATCTCTCTCTCACTGATGTTATTCCCCATCTGCCGTCTTGGTTCATCTCACCACAGAAGGGCATTT
AGTCCTACCCAGCCATCGGCTGCGTATGACAGCAGGATGGCACTTCCCATTTCTCTGTGGTTAGTGCTCG
AGTGAAAACCTCTTTCAGCTGAGTCCTCTGAGGTTCTGCTGTTGAGTCCTGGGTGGCTGATGGAATGATT
GAGGAGGTCTGGTCACCCTCAAGCGCCGTCATCGCCTTGTTTCCATGGGCTTCTGTCACACAAAATGAAG
AACAGAAATGTTAGGACTTAAGAGAATGTTTGGAATTCACACCTCTTTGCAGTCCTTTCAAGGCTGCTGC
TCTGTGCTGTGTCCCATGCATGTGAAAGTAGAGCTGTGATGGCTGCTGGGACGCTTGCAAAGATCATGTG
TGAGAATTGAGCACAAGACCACAAATTATTACTGCTTGATGCGCTTGTTAAAACTCTATCTGCCAGGAAA
CCAAATTTTCTTTTCTTTTCTTTTTTTTTGAGACAGGGCCTCACTCTGTTGCCCAGGCTGGAGTGCAG
TGGCGCGATCTCAGCTCACTGCAGCCTCCACCTACTGGGCTCAAGTGATCCTCCCACCTCAGCCTCCCGA
GTAGCCGGGACCACAGGCGTGTATGACTGGCTACGCCTGGCTAATTTTTGTATTTTTAATAGAGACGAGT
TTCACCATGTTGCCCAGGATGGTCTGGAACTCCTGGGCTCAAGTGATCTGCCCACTTCCGCCTCCCAAAG
TGTTGGGATTATGGCCATTAGCCACTGTACCTGGCACAATTTTTTTTGTACCCTCCTTTATGCCAAGAA
TCAGTCCTAATTTCTTTACTATGTGAAGTAACTTTTAAAGGTAATAGAAAAGGCCAGGCACAGTGGCTCA
TGCCTGTAATCCCAGCGCCGTGGCTCACGCCTGTAATCCCAGCACTTTGAGAGGCTGAGGCGGGTGGAT
CACTTAAGGTCAGGAGTTAGAGACCAGCCTGACCAACATGGTGAAACACTGTCTCTACTAAAAATACAAA
ATTAGCTGGGTTTGGTGGCGCACGCCTGTAATCCCAGCTACCTGAGAGGTTGAGGCAGGAGAATCGCTTG
```

Figure 20 (Continued)

```
AACCTGGGAGGCAGAGGTTGCAGTGAGCCGAGATGGTGCCATTGCACTCCGACCTGGGCAACAGAGCGAA
ACACTGTCTCAAAAAAAAAAAAAAAAGTAACAGAAAAAAGAGTGAAATATATTAGCTATCTTTTATTCTG
AGCCAAAACTTGACAGATGTGGGAAATCTTCATATAGTGTATGAAAATTTCATTGTACAGGGAAATTATT
TTCCTCTGTGTCTTTTCTTTTACTATAAAGTGATTCAGAATTTTACTGTTACTATAAAATTATGCAAAGT
ATTGTGACAAAACTGCATCAATTTGTTGACTATTAAAGTGCTCCTTGAACATTA

>gi|319004059|ref|NM_014245.4| Homo sapiens ring finger protein 7 (RNF7),
transcript variant 1, mRNA
GCCGGGGTCTAGGCACCACGGTGGCTGGCGGCCTGCGGGCGGCGCTGTGGCCCGTCGGCGGCTCCACAG
AGCCGCCCTAGCCTTCCGCCTTCCCCAAGCCAACGTCTCCGCCGTCGGCTCCGCGGCGCCGCCATGGCCG
ACGTGGAAGACGGAGAGGAAACCTGCGCCCTGGCCTCTCACTCCGGGAGCTCAGGCTCCAAGTCGGAGG
CGACAAGATGTTCTCCCTCAAGAAGTGGAACGCGGTGGCCATGTGGAGCTGGGACGTGGAGTGCGATACG
TGCGCCATCTGCAGGGTCCAGGTGATGGATGCCTGTCTTAGATGTCAAGCTGAAAACAAACAAGAGGACT
GTGTTGTGGTCTGGGGAGAATGTAATCATTCCTTCCACAACTGCTGCATGTCCCTGTGGGTGAAACAGAA
CAATCGCTGCCCTCTCTGCCAGCAGGACTGGGTGGTCCAAAGAATCGGCAAATGAGAGTGGTTAGAAGGC
TTCTTAGCGCAGTTGTTCAGAGCCCTGGTGGATCTTGTAATCCAGTGCCCTACAAAGGCTAGAACACTAC
AGGGGATGAATTCTTCAAATAGGAGCCGATGGATCTGTGGTCCTTTGGGACTCATCAAAGCCTTGGTTTA
GCATTTTGTCAGTTTTATCTTCAGAAATTCTCTGCGATTAAGAAGATAATTTATTAAAGGTGGTCCTTCC
TACCTCTGTGGTGTGTCGCGCACACAGCTTAGAAGTGCTATAAAAAAGGAAAGAGCTCCAAATTGAAT
CACCTTTATAATTTACCCATTTCTATACAACAGGCAGTGGAAGCAGTTTCAGAGAACTTTTTGCATGCTT
ATGGTTGATCAGTTAAAAAGAATGTTACAGTAACAAATAAAGTGCAGTTTAAAACCCAACTCTTACTCT
TAATTTGTTCCTAATACGTATTTTTGGCAGGGAGAGGGAACGGTCCATGAAATCTTTATGTGATATAAGG
ATTTTAAGTTTGGGCCAGTGAACAGGGTAAATAAAATTTAACTTTTGAGCATATGGAATTTTGATTGCCT
TTAAAGTTACTATTCTGTATCATTGATTCATCAAGAAAACCTAGATCTGCACTCACCTCACTGTTCAATC
ATTGAGTGGTAAAGGACAGAAGTATTTTCTAGTTCTGGTCAGATGATATAATTTTTTTTTTTTTTTTTG
TGGGGTGAAGTCTTGCTCTGCCACCCAGGCTGGAGTGCAGTGGCATGATGTCAACTCACTGCAACCTCC
GCCTCCCGGGTTCAAGTGATTCTCCTGCCTCAGCCTCCCGAGTAGCTGGGATTACAGGTGTGTGCCACCA
CACCCGGCTAATTTTTGTATTTTTAGTAGAGACGGGATTTCCCCATGTTGGCCAGGCTGGTCTCAAACTC
CTGACCTCAGGTGATTCGCCCACCTCAGCCTCCCAAAGTGCTGGGATTACAGGTGTGGGCCACTGCACCT
GGCCCAGATGATATAATTTAACTGTGTTTTAGGTAACATGTTAATGAGGGAAATGTTTACCAGTGTAGC
ATTGGATCAAAAAGTTTATCACACAGTGTTTTAATAAATGGTTTATTCTGCTTACCTTATTTGAATTGTC
ATTATAATTTTATATGCAACCTTAATTTGTCAAGTAAATACTTTCATTTAATTTGAAAGAATTCATATTC
ATTTGCTCTTTCATTTGACAATAATAAAATTTAAGGTTTATTACCTGGAAAGAGTGCAAGAAAATACTAA
ACAACTTTATCAAACTGATTCACACTGAGGGGAGGTTATTTTGTAACAAATAATGGACCACAAGTTCATT
TTGTATTCTTCTGTAGTAGAGGCTACTGATATGAATTTAAGAAAAAACCTTAGAATCTTAACTTTTCACA
TCTGCAGATGCAGTGTGCCATTCTGAATTTTTCAATCTAAGGGATGTGGATACATAGAATGTTTAAAAAG
ATAACAATTAGAATGAAAAATTAAAATTATGTATGCTTTTAAAAAAAAAA >gi|41281452|ref|NM_014720.2| Homo sapiens STE20-like kinase (SLK), mRNA
CTTAAGTGCAAGGAACTCTGTGTTGGGAGGAAAAATGTCCTTCTTCAATTTCCGTAAGATCTTCAAGTTG
GGGAGCGAGAAGAAGAAGAAGCAGTACGAACACGTGAAGAGGGACCTGAACCCCGAAGACTTTTGGGAGA
TTATAGGAGAACTGGGCGACGGAGCCTTTGGGAAAGTGTACAAGGCCCAGAATAAAGAGACCAGTGTTTT
```

Figure 20 (Continued)

```
AGCTGCTGCAAAAGTGATTGACACTAAATCTGAAGAAGAACTTGAAGATTACATGGTAGAGATTGACATA
TTAGCATCTTGTGATCACCCAAATATAGTCAAGCTTCTAGATGCCTTCTATTATGAGAACAATCTTTGGA
TCCTCATTGAATTTTGTGCAGGTGGAGCAGTAGATGCTGTGATGCTTGAACTTGAGAGACCATTAACTGA
GTCCCAAATACAAGTAGTTTGCAAGCAGACTTTAGATGCATTGAACTACTTACATGATAATAAGATCATC
CACAGAGATCTGAAGGCTGGCAACATTCTCTTTACCTTAGATGGAGATATCAAATTGGCGGATTTTGGAG
TATCAGCTAAAAACACGAGGACAATTCAAAGAAGAGATTCCTTTATTGGTACACCATATTGGATGGCTCC
TGAAGTAGTCATGTGTGAAACATCTAAGGACAGACCCTATGACTACAAAGCTGATGTTTGGTCCCTGGGT
ATCACTTTAATAGAAATGGCTGAGATAGAACCACCTCATCATGAATTAAATCCAATGCGAGTGCTGCTAA
AAATAGCAAAATCTGAGCCACCTACATTAGCACAGCCATCCAGATGGTCTTCAAATTTTAAGGACTTTCT
AAAGAAATGCTTAGAAAAGAATGTGGATGCCAGGTGGACTACATCTCAGCTGCTGCAGCATCCCTTTGTT
ACTGTTGATTCCAACAAACCCATCCGAGAATTGATTGCAGAGGCGAAGGCTGAAGTAACAGAAGAAGTTG
AAGATGGCAAAGAGGAAGATGAAGAGGAGGAAACAGAAAATTCTCTGCCAATACCTGCAAGTAAGCGTGC
ATCTTCTGACCTTAGTATCGCCAGCTCTGAAGAAGATAAACTTTCACAAAATGCTTGTATTTTGGAGTCT
GTCTCAGAAAAAACAGAACGTAGTAACTCTGAAGATAAACTCAACAGCAAAATTCTTAATGAAAAACCCA
CCACTGATGAACCTGAAAAGGCTGTGGAGGATATTAATGAACATATTACCGATGCTCAGTTAGAAGCAAT
GACTGAACTCCATGACAGAACAGCAGTAATCAAGGAGAATGAAAGAGAGAAGAGGCCCAAGCTTGAAAAT
CTGCCTGACACAGAAGACCAAGAAACTGTGGACATTAATTCAGTCAGTGAAGGAAAAGAGAATAATATAA
TGATAACCTTAGAAACAAATATTGAACATAATCTAAAATCTGAGGAAGAAAAGGATCAGGAAAAGCAACA
GATGTTTGAAAATAAGCTTATAAAATCTGAAGAAATTAAAGATACTATTTTGCAAACAGTAGATTTAGTT
TCTCAAGAGACTGGAGAAAAAGAGGCAAATATTCAGGCAGTTGATAGTGAAGTTGGGCTTACAAAGGAAG
ACACCCAAGAGAAATTGGGGGAAGACGACAAAACTCAAAAAGATGTGATCAGCAATACAAGTGATGTGAT
AGGAACATGTGAGGCAGCAGATGTGGCTCAGAAAGTGGATGAAGACAGTGCTGAGGATACGCAGAGTAAT
GATGGGAAAGAAGTGGTCGAAGTAGGCCAGAAATTAATTAATAAGCCCATGGTGGGTCCTGAGGCTGGTG
GTACTAAGGAAGTTCCTATTAAAGAAATAGTTGAAATGAATGAAATAGAAGAAGGTAAAAATAAGGAACA
AGCAATAAACAGTTCAGAGAACATAATGGACATCAATGAGGAACCAGGAACAACTGAAGGTGAAGAAATC
ACTGAGTCAAGTAGCACTGAAGAAATGGAGGTCAGAAGTGTGGTGGCTGATACTGACCAAAAGGCTTTAG
GAAGTGAAGTTCAGGATGCTTCTAAAGTCACTACTCAGATAGATAAAGAGAAAAAAGAAATTCCAGTGTC
AATTAAAAAAGAGCCTGAAGTTACTGTAGTTTCACAGCCCACTGAACCTCAGCCTGTTCTAATACCCAGT
ATTAATATCAACTCTGACAGTGGAGAAAATAAAGAAGAAATAGGTTCTTTATCAAAAACTGAAACTATTC
TGCCACCAGAATCTGAGAATCCAAAGGAAAATGATAATGATTCAGGCACTGGTTCCACTGCTGATACTAG
CAGTATTGACTTGAATTTATCCATCTCTAGCTTTCTAAGTAAAACTAAAGACAGTGGATCGATATCTTTA
CAAGAAACAAGAAGACAAAAGAAAACATTGAAGAAAACACGCAAATTTATTGTTGATGGTGTAGAAGTGA
GTGTAACAACATCAAAGATAGTTACAGATAGTGATTCCAAAACTGAAGAATTGCGGTTTCTTAGACGTCA
GGAACTTCGGGAATTAAGATTTCTTCAGAAAGAAGAGCAAAGAGCCCAACAACAGCTCAATAGCAAACTA
CAGCAACAACGAGAACAAATTTTCCGGCGCTTTGAGCAGGAAATGATGAGTAAAAAGCGACAATATGACC
AGGAAATTGAGAATCTAGAAAAACAGCAGAAACAGACTATCGAACGCCTGGAACAAGAGCACACAAATCG
CTTGCGAGATGAAGCCAAACGCATCAAAGGAGAACAAGAGAAAGAGTTGTCCAAATTTCAGAATATGCTG
AAGAACCGAAAGAAGGAGGTTATAAATGAAGTGGAGAAAGCACCCAAAGAGCTGAGAAAAGAGCTCATGA
AACGCAGGAAAGAGGAGCTTGCACAAAGCCAGCATGCTCAGGAACAAGAGTTTGTTCAGAAACAACAGCA
AGAATTAGATGGCTCTCTGAAAAAGATCATCCAGCAGCAGAAGGCAGAGTTAGCTAATATTGAGAGAGAG
TGCCTGAATAACAAGCAACAGCTCATGAGAGCTCGAGAAGCTGCAATTTGGGAGCTCGAAGAACGACACT
TACAAGAAAAACACCAGCTGCTCAAACAGCAGCTTAAAGATCAGTATTTCATGCAAAGACATCAGCTACT
```

Figure 20 (Continued)

```
TAAGCGCCACGAGAAGGAAACAGAGCAAATGCAGCGTTACAATCAAAGACTTATTGAGGAATTGAAAAAC
AGACAGACTCAAGAAAGAGCAAGACTGCCCAAGATTCAGCGCAGTGAAGCCAAGACTCGAATGGCCATGT
TTAAGAAGAGTTTGAGAATTAACTCAACAGCCACACCAGATCAGGACCGTGATAAAATTAAACAGTTTGC
TGCACAAGAAGAAAAGAGGCAGAAAAATGAGAGAATGGCTCAGCATCAGAAACATGAGAATCAAATGCGA
GATCTTCAGTTGCAGTGTGAAGCCAATGTCCGCGAACTGCATCAGCTGCAGAATGAAAAATGCCACTTGT
TGGTTGAGCATGAGACTCAGAAACTGAAGGAGTTAGATGAGGAACATAGCCAAGAATTAAAGGAGTGGAG
AGAGAAATTGAGACCTAGGAAAAAGACACTGGAAGAAGAGTTTGCCAGGAAACTACAGGAACAGGAAGTA
TTCTTTAAAATGACTGGGGAGTCTGAATGCCTTAACCCATCAACACAGAGCCGGATTTCCAAATTTTATC
CTATTCCCAGCTTGCATTCCACCGGATCATAACAAAGGGAAGCATTCTGTGCGTGGGTTTGGCTCTTTCA
GTATGTCATTCTGTTCTCATCTTCTGCCACAGTCTCTCAGATAGCTCATGAAGACAATCACCTGCCTCAC
CTTCTAGGTGTTTTCCTTTTTGTTTTTTTGTTTGTTTTGTTTTAAGCAAAGATGAAGGGAAAACGA
ACTAAGACAGACGCTAGGCCATGTTGGCAAAGTAGCATCTTGGTGACTAAGGTGACTTTGTATATTCATC
TTAAAAATTATGTTCTTTAGACACTGCTACCTGAAAACTGTTGGAGAAATAATGTTTAAAGTTATTTAAG
AAAAACTGTTACATCACTAAGTATTAATAAATTCTTCTTACCTGACGTAACTTCTCAATGCCTAAATTCT
GTAGTTGAAGCTCTGCTGCAGAGAGTTGGGATAATTTTCTTTTGGTGGATCAGCTCTCATAAAAAAGCTA
TGATTTGCTCAAATATGCTGTTGACTCAGTAAATGAATATATTTTTTCTTTAAATAGGAACAACCTCTT
TTAAAAGAGAAAAATTATTTCAGTGATTTGTCAAAACGAATTACCTCTTTTGGCATGAGCTAATAATTGA
GGGTGCTAATTTTCTTAAGATAGTGCCTAAAACACTAAATTTCAGTCAAGTCGTAAGTAGGATTTTCTTT
TTGATCAACAGGGACAAAAACATCTTTAGAATTAAAAACATGGTTGTTTTGGAATTTTTGCTTCTCTTAC
CGTTTGATAGAAATTTTCATCCTAAAATACATGTACAAAGTTTGGAAAGATGAAAAAAAGAGGTAGCTTT
TAGATTGCAAATTGGAAATGTAAAACTCATGAAATTTAAGCAATATAGGTTTAGCTATCTGTGTTTATTT
TCTAAAATAATACCTGAGCTGGTTAAATGATTTCTCTCCATCTTAGCTAATTCTGTTTAAAACTCTGTCA
GAGGCCTGCAGGCTGTGAGTTATATTTATAAATATATCTTCAGAAATTAATCTTAAAAGAGGCATTAGTT
CAGAATACTTTTTTAAAAGTTTAAATTAAATATTTAGGCACGTCAGAAATTACTTTTCCTTATTTTGAAA
TGAGGCTACTTATGTCTTGGTTTTATTTTGTTCCATGTTTAAATCATTCACTTTGATTTGAGTGGGAAAA
GCCTGAAGCCTTTATCATGTGGTTGCTGGTGTGTGTAATTATTAATGAAATGTTCACTCCTAGTCCCTTA
TGAGGCTTAGAATTTCAACCACGTGTCAGGTCAGACAGTATTATAAACTGTACTTTGCTGTCTGAGACAG
CACATTTGTGAATGATGCTTCTGCCTGCCATTTTCAACCTATTCTCTCTTAAGAGTGCTAGGTACCAAA
TTGTGAAAGTTTGTTTTCAGTTATATTACTTTTGAGGCTGGTGAAAAATTTAAATGTAACTTTGTGGGAA
CACTGATTCATATTTAGAAAATGTAAATGTCTGTAGCACTTTCTTGCAGTTAATTTGAAAACTTTGGATG
CTGAACCTTGTTTGTCAGTGATTTAGATGATTTAAAAATGCATGTGTGATTTGAATTTTATAATTGTTTT
GACAAGCATAATTTACTTGGACAACTTCGTAGGTAGCCTTAACTTCTGGCCAAGTTTGTTTTTTATATAA
ATATATATACATATATACATATTATGTATGGTTGTAAATTCATACACTTATCACATGAATGTGTTACTGT
ATACAAAACTCTTAATGCTTTATTCTCAAATGCTGGGTTGAAAAATGTTTTGAAAGCCTTTTAAAATATA
TATCTTTATAAAGTAATATTCAGGATGATGATAAAAATTGTTTATATTGTTATGATAAAAATGACAGTAT
AATGTTAAAAAAAAAAAAAAAAAAAAAAA

>gi|119220576|ref|NM_014815.3| Homo sapiens mediator complex subunit 24 (MED24),
transcript variant 1, mRNA
CTCCCTCGAGTCCCTGAGTCTCTGTAGTGCCTCAGCTCCTGGATGTCCTCCCTTAAAGGAGAAGAACAAT
GCGGGCCGACTAGACGAGTCCCTTAGTTTCCTCGCCGGCGCAGACAAATACGGTTTCAGTCCAAGGAACT
ACCATTCCCAGAAGACAGCGGGGCGTTCCTTGCTGCATTTCTATTGGTTGGCGTTTGTTACTCCCAGCCA
```

Figure 20 (Continued)

```
ATAGAAAGTGAGCTTCTTGACAAGTGCCAAAATGGCGATGCCTACCACCTAGAACTGGATTGTGCGCTGG
CCGCCACCGCTGCCACCTGCTCAGAGTGAAATAATGAAGGTGGTCAACCTGAAGCAAGCCATTTTGCAAG
CCTGGAAGGAGCGCTGGAGTGACTACCAATGGGCAATCAACATGAAGAAATTCTTTCCTAAAGGAGCCAC
CTGGGATATTCTCAACCTGGCAGATGCGTTACTAGAGCAGGCCATGATTGGACCATCCCCCAATCCTCTC
ATCTTGTCCTACCTGAAGTATGCCATTAGTTCCCAGATGGTGTCCTACTCTTCTGTCCTCACAGCCATCA
GTAAGTTTGATGACTTTTCTCGGGACCTGTGTGTCCAGGCATTGCTGGACATCATGGACATGTTTTGTGA
CCGTCTGAGCTGTCACGGCAAAGCAGAGGAATGCATCGGACTGTGCCGAGCCCTTCTTAGCGCCCTCCAC
TGGCTGCTGCGCTGCACGGCAGCCTCTGCAGAGCGGCTGCGGGAGGGGCTGGAGGCCGGCACTCCAGCCG
CTGGGGAGAAGCAGCTTGCCATGTGCCTTCAGCGCCTGGAGAAAACCCTCAGCAGCACCAAGAACCGGGC
CCTGCTGCACATCGCCAAACTAGAGGAGGCCTCTTCTTGGACTGCCATCGAGCATTCTCTCTTGAAACTT
GGAGAGATCCTGGCCAATCTCAGCAACCCGCAGCTCCGGAGTCAGGCCGAGCAGTGTGGCACCCTCATTA
GGAGCATCCCCACGATGCTGTCTGTGCATGCGGAGCAGATGCACAAGACCGGCTTCCCCACTGTCCACGC
CGTGATCCTGCTCGAGGGCACCATGAACCTGACAGGCGAGACGCAGTCCCTGGTGGAGCAGCTGACGATG
GTGAAGCGCATGCAGCATATCCCCACCCCACTTTTTGTCCTGGAGATCTGGAAAGCTTGCTTCGTGGGGC
TCATTGAGTCTCCCGAGGGTACGGAGGAGCTCAAGTGGACAGCTTTCACTTTCCTCAAGATTCCACAGGT
TTTGGTGAAGTTGAAGAAGTACTCTCATGGAGACAAGGACTTCACTGAGGATGTCAACTGTGCTTTTGAG
TTCCTGCTGAAGCTCACCCCCTTGTTGGACAAAGCTGACCAGCGCTGCAACTGTGACTGTACAAACTTCC
TGCTCCAAGAATGTGGCAAGCAGGGGCTTCTGTCTGAGGCCAGCGTCAACAACCTTATGGCTAAGCGCAA
AGCGGACCGAGAGCACGCACCCCAGCAGAAATCGGGAGAGAATGCCAACATCCAGCCCAACATCCAGCTG
ATCCTCCGGGCGGAGCCCACTGTCACAAACATCCTCAAGACGATGGATGCAGACCACTCTAAGTCACCGG
AGGGACTGCTGGGAGTCCTGGGCCACATGCTGTCCGGGAAGAGTCTGGACTTGCTGCTGGCTGCCGCCGC
CGCCACTGGAAAGCTGAAATCCTTCGCCCGGAAATTCATCAATTTGAATGAATTCACAACCTATGGCAGC
GAAGAAAGCACCAAACCGGCCTCCGTCCGGGCCCTGCTGTTTGACATCTCCTTCCTCATGCTGTGCCATG
TGGCCCAGACCTATGGTTCAGAGGTGATTCTGTCCGAGTCGCGCACAGGAGCTGAGGTGCCCTTCTTCGA
GACCTGGATGCAGACCTGCATGCCTGAGGAGGGCAAGATCCTGAACCCTGACCACCCCTGCTTCCGCCCC
GACTCCACCAAAGTGGAGTCCCTGGTGGCCCTGCTCAACAACTCCTCGGAGATGAAGCTAGTGCAGATGA
AGTGGCATGAGGCCTGTCTCAGCATCTCAGCCGCCATCTTGGAAATCCTCAATGCCTGGGAGAATGGGGT
CCTGGCCTTCGAGTCCATCCAGAAAATCACTGATAACATCAAAGGGAAGGTATGCAGTCTGGCGGTGTGT
GCTGTGGCTTGGCTTGTGGCCCACGTCCGGATGCTGGGGCTGGATGAGCGTGAGAAGTCGCTGCAGATGA
TCCGCCAGCTGGCAGGGCCACTGTTTAGTGAGAACACCCTGCAGTTCTACAATGAGAGGGTGGTGATCAT
GAACTCGATCCTGGAGCGCATGTGTGCCGACGTGCTGCAGCAGACAGCCACGCAGATCAAGTTTCCCTCC
ACCGGGGTGGACACAATGCCCTACTGGAACCTGCTGCCCCCAAGCGGCCCATCAAAGAGGTGCTGACGG
ACATTTTTGCCAAGGTGCTGGAGAAGGGCTGGGTGGACAGCCGCTCCATCCACATCTTTGACACCCTGCT
GCACATGGGCGGCGTCTACTGGTTCTGCAACAACCTGATTAAGGAGCTGCTGAAGGAGACGCGGAAGGAG
CACACGCTGCGGGCAGTGGAGCTGCTCTACTCCATCTTCTGCCTGGACATGCAGCAAGTGACCCTGGTCC
TGCTGGGCCACATCCTACCTGGCCTGCTCACTGACTCCTCCAAGTGGCACAGCCTCATGGACCCCCCGGG
CACTGCTCTTGCCAAGCTGGCCGTGTGGTGTGCCCTCAGTTCCTACTCCTCCCACAAGGGACAGGCGTCC
ACCCGCCAGAAGAAGAGACACCGCGAAGACATTGAGGATTATATCAGCCTCTTCCCCCTGGACGATGTGC
AGCCTTCGAAGTTGATGCGACTGCTGAGCTCTAATGAGGACGATGCCAACATCCTTTCGAGCCCCACAGA
CCGATCCATGAGCAGCTCCCTCTCAGCCTCTCAGCTCCACACGGTCAACATGCGGGACCCTCTGAACCGA
GTCCTGGCCAACCTGTTCCTGCTCATCTCCTCCATCCTGGGGTCTCGCACCGCTGGCCCCCACACCCAGT
TCGTGCAGTGGTTCATGGAGGAGTGTGTGGACTGCCTGGAGCAGGGTGGCCGTGGCAGCGTCCTGCAGTT
```

Figure 20 (Continued)

CATGCCCTTCACCACCGTGTCGGAACTGGTGAAGGTGTCAGCCATGTCCAGCCCCAAGGTGGTTCTGGCC
ATCACGGACCTCAGCCTGCCCCTGGGCCGCCAGGTGGCTGCTAAAGCCATTGCTGCACTCTGAGGGGCTT
GGCATGGCCGCAGTGGGGGCTGGGGACTGGCGCAGCCCCAGGCGCCTCCAAGGGAAGCAGTGAGGAAAGA
TGAGGCATCGTGCCTCACATCCGCTCCACATGGTGCAAGAGCCTCTAGCGGCTTCCAGTTCCCCGCTCCT
GACTCCTGACCTCCAGGATGTCTCCCGGTTTCTTCTTTCAAAATTTCCTCTCCATCTGCTGGCACCTGAG
GAGAGTGAGCAGCCTGGACCACAAGCCCAGTGGTCACCCTGTGTGCGCCCGCCCCAGCCCAGGAGTAGT
CTTACCTCTGAGGAACTTTCTAGATGCAAAGTGTGTATGTGTGTGTGTGTGTGTGTGTGTGTGTTTGT
GTGTATTTTGTAATATGTGAGGGAAATCTACCTTCGTTCATGTATAAATAAAGCTCCTCGTGGCTCCCTT
TGTGAAAAAAAAAAAAAAAAAAAAA

>gi|238859596|ref|NM_015014.2| Homo sapiens RNA binding motif protein 34 (RBM34), transcript variant 1, mRNA
AGCTGCAGTCTGGGAGTCTTTGGAGTAAGAATGGCCTTGGAAGGGATGAGCAAACGGAAGAGAAAGAGAA
GTGTCCAGGAGGGAGAGAATCCTGACGACGGCGTTCGCGGGAGTCCGCCGGAAGACTACAGGCTTGGACA
GGTCGCCAGTAGCTTATTTCGCGGCGAACACCATTCCAGAGGTGGCACCGGTCGGCTGGCGTCCCTCTTC
AGTTCTCTGGAGCCCCAGATTCAACCCGTGTACGTGCCTGTGCCTAAACAAACCATCAAAAAAACGAAAC
GGAATGAGGAGGAAGAAAGTACATCCCAGATTGAAAGACCACTTTCGCAAGAACCTGCCAAAAAAGTGAA
AGCGAAGAAGAAACACACTAACGCAGAAAAAAGTTGGCAGACAGGGAAAGCGCTCTAGCGAGTGCTGAT
TTAGAAGAAGAAATTCACCAGAAACAAGGGCAGAAAAGGAAAAATTCTCAACCTGGTGTTAAAGTAGCAG
ATAGAAAAATACTTGATGACACAGAAGACACAGTTGTCAGTCAAAGAAAGAAAATTCAAATCAACCAAGA
AGAAGAGAGATTAAAGAATGAGAGAACTGTGTTTGTTGGGAATTTGCCTGTTACATGTAATAAGAAGAAG
CTGAAGTCGTTTTTTAAAGAGTATGGACAAATAGAATCTGTACGATTTCGTTCTCTGATTCCAGCAGAGG
GAACGCTATCCAAAAAGTTGGCAGCAATAAAACGTAAAATTCATCCTGATCAGAAAAATATTAATGCCTA
TGTTGTGTTTAAGGAGGAGAGTGCTGCCACGCAAGCATTGAAAAGAAATGGGGCCCAGATTGCAGATGGA
TTTCGTATTAGAGTTGATCTCGCATCTGAGACCTCATCTAGAGACAAGAGATCGGTTTTTGTGGGGAATC
TCCCTTATAAAGTTGAAGAATCTGCCATTGAGAAGCACTTTCTGGACTGTGGAAGTATCATGGCCGTGAG
GATTGTGAGAGACAAAATGACAGGCATCGGCAAAGGGTTTGGCTATGTGCTCTTTGAGAATACAGATTCT
GTTCATCTTGCTCTGAAATTAAATAATTCTGAACTCATGGGGAGAAAACTCAGAGTCATGCGTTCTGTTA
ATAAAGAAAAATTTAAACAACAAAATTCAAATCCACGATTGAAGAATGTCAGTAAACCTAAGCAGGGACT
TAATTTTACTTCCAAAACTGCAGAAGGACATCCTAAAAGCTTATTTATTGGAGAAAAAGCTGTTCTCCTT
AAAACGAAGAAGAAAGGACAGAAGAAAAGTGGACGCCCTAAGAAACAGAGAAAACAGAAATAACAACCAG
GAACTGCTTTTTCTTTTCCTGCTGAGTACTGCTAATAAAAGTGCTATTATCTGCTGATAGCATCGTCTGC
TATTCATGTGTTGAGTTTTATACTTCTTTATGGATGGTGTATGTGAAATGTGGAGACTTCCACATTCTCA
GTTTATTCACATTGTGATACTACCTTTGAAGGTTTTTTGTTTTTGTTTTGTTTTTGAGATGGAGTTTG
GCTGTTGTCTCCCAGGCTGGAGTGCAGTGGCGTGATCTTGGCTCACTGCAACCTCTGCCTTCTGGGTTCA
AGCGCTTCTCCTGCCTCAGCCTCCCAAGTAGCTGGGATTACAGGCGCCTGCCACCACGCCTGGCTAATTT
TTTGTATTTTTAGTAGAGACGGGGTTTCACCATGTTGGCCAGGCTGGTCTCGAACTCCTGACCTCAGGTG
ATCCACCTGCCTTGGCCTCTCAAAGTGCTGGGATTACAGGCGTGAGTCACTGCACCCAAGCCTCCTTTCT
CTTTTGCCTATTAAACCTCTGCTCTTAACCTTAAAAAAAAAAAAAAAAAAA >gi|195976781|ref|NM_015138.4| Homo sapiens Rtf1, Paf1/RNA polymerase II complex component, homolog (S. cerevisiae) (RTF1), mRNA

Figure 20 (Continued)

```
AGCGGAGCGCGCATGCGCGGTCGCCTTTGTGTGGGTCGAGCAGCGGCGGCGGCGGCAGTGGCGGTCC
CACTGGCAGGCGGGCAAGAGGGGAGTCCGGGCGGCGGCCGGCGTGGGAGCCGGGGGACCACCATGGTAAA
GAAGCGGAAAGGCCGCGTCGTGATCGACTCGGACACAGAGGACAGCGGCAGCGACGAGAACCTGGATCAG
GAGCTCTTGTCCCTGGCAAAGCGAAAGCGCAGTGACTCTGAGGAGAAGGAGCCGCCTGTGAGTCAGCCTG
CAGCCTCGTCAGACTCGGAGACGTCTGACAGTGACGATGAGTGGACATTTGGGAGCAATAAAAATAAGAA
GAAAGGAAAAGCCAGAAAAATAGAGAAGAAAGGAACCATGAAGAAACAGGCCAACAAAACTGCCTCCTCA
GGCAGTTCAGACAAAGACAGTTCAGCTGAGAGCTCAGCCCCTGAGGAAGGTGAAGTGTCAGACTCTGACA
GCAACAGCTCCTCTTCCAGTTCAGATTCAGACTCTTCCTCAGAAGATGAAGAGTTCCATGATGGCTATGG
AGAAGACCTCATGGGAGATGAGGAAGACAGGGCCCGTCTGGAACAGATGACAGAGAAAGAGAGAGAGCAA
GAACTGTTCAATCGCATAGAGAAGAGGGAGGTGTTGAAAAGAAGATTTGAAATCAAGAAAAAACTAAAAA
CAGCCAAAAAGAAAGAAAAGAAAGAAAAGAAGAAAAAGCAAGAAGAGGAGCAAGAAAAGAAAAAACTGAC
ACAGATTCAAGAATCTCAGGTAACATCCCACAACAAGGAACGGCGTTCCAAGCGGGATGAGAAACTAGAC
AAGAAATCTCAAGCCATGGAGGAGCTAAAAGCAGAGCGAGAAAAACGAAAGAACAGAACAGCTGAGCTCC
TTGCCAAAAAACAGCCATTAAAAACCAGTGAGGTCTACTCTGATGATGAAGAGGAGGAAGAGGATGACAA
ATCCAGTGAAAAGTCAGACCGCTCATCACGAACATCATCGTCTGATGAAGAAGAGGAGAAAGAAGAGATC
CCTCCCAAATCCCAACCAGTTTCCTTACCTGAAGAATTGAATCGGGTTCGATTATCACGGCATAAGCTAG
AACGCTGGTGTCACATGCCCTTCTTTGCTAAAACTGTCACAGGATGTTTTGTGCGGATTGGCATCGGAAA
CCACAACAGCAAACCAGTTTACCGGGTCGCTGAGATTACGGGTGTTGTGGAAACTGCCAAAGTTTACCAA
CTAGGTGGCACCAGAACAAACAAAGGGCTGCAACTACGGCATGGCAATGACCAACGCGTGTTCCGTTTAG
AGTTTGTCTCAAACCAAGAATTCACCGAAAGTGAGTTTATGAAGTGGAAAGAAGCGATGTTCTCTGCTGG
CATGCAGTTGCCCACTCTAGATGAAATCAATAAAAAGGAATTATCTATTAAAGAAGCTCTTAATTATAAA
TTCAATGATCAGGACATTGAAGAGATTGTAAAAGAGAAAGAAAGGTTCAGAAAAGCTCCACCCAACTACG
CTATGAAGAAGACTCAGCTACTGAAGGAAAAGGCCATGGCTGAGGACCTGGGGGATCAGGACAAGGCCAA
ACAAATCCAAGATCAACTGAATGAGCTGGAGGAACGGGCAGAGGCCCTGGACCGCCAGCGGACCAAGAAC
ATATCCGCTATCAGTTACATCAACCAGCGGAACCGGGAGTGGAACATTGTAGAGTCTGAGAAGGCCCTTG
TGGCTGAAAGTCACAACATGAAAAACCAACAGATGGATCCCTTTACTCGGCGGCAGTGCAAGCCTACCAT
CGTTTCTAATTCCAGAGACCCAGCTGTTCAAGCTGCCATCTTGGCCCAGCTGAATGCAAAATACGGTTCT
GGAGTGTTACCAGATGCTCCAAAGGAAATGAGCAAGGGTCAAGGCAAAGATAAAGATTTGAATTCTAAGT
CAGCCAGTGACCTCTCAGAAGATCTGTTCAAAGTACACGATTTTGATGTGAAGATTGACTTACAAGTTCC
CAGCTCAGAGTCAAAGGCTTTAGCCATCACCTCCAAGGCTCCGCCAGCCAAGGATGGGGCTCCAAGGAGA
TCTCTGAACTTGGAAGACTACAAAAAACGACGAGGGCTTATTTGAGCACACCCAGCCTGCTGCTTCTGAC
CCTGCATGCCCCATCGCAGCGTCCCACCTTTCCTCCTTTCCTTTGATTTAGCCTCTTTGGGCTGGAGCAG
CTGTTGAACTGGGAAGAGACTCTAAACTGCCAGTCATCTGTAATATAAACCATTTGCTGTATAGACCTCC
TTTGTCTGCACACCATCTCCCACCAGCCTCCCCTCCCCAGGGCCCCACCCAGTGTGGGCCTGGGCTCTC
TTGGGCTTTATCCATGTCTTTAGATTTGTGTTTGCCTTTTGTTTTTTTAACCGCGCAGTTCATTGGCCAC
TCTGCACGCATTCAGTATTACCATGGAGCTGGGAATCTTGCTGGAGCCCCTGGGGCAATAGCAGCAGCAC
CAGGCGGTCTCCTCTACAGACTGCCTTGGCCCACCCATTGAACATTCGGCACGTGACCTTGTGGGGGGAG
CGGGGATTGGGCACCTGCGATCCTCTTTCCTCTCTTCATCTTTCTCTTCTGCCCTTCTTTTTGGAAGAAG
GGGTTTCAAAACCAGTTTAGTTTCCAAAAAGTGTACATTTGTGGGGGGGGGGTCTAATTTGAGAGCGA
GAGTGTGTATGTGTGTGTGTAAGTGTGTGGATTTTTTATCATTTTTTTAAAATGCAGTACTCTTTGT
ATCAGTCTGTCATGGGTCTATAGCTGTTTCAGATTTTTTTCAGCTGTACTTGAGCATCTGAAACTGCAAG
AAAGAAACTCATTAAATGTGATTCTTCTTACTAAACAGGCCTGACTGCTGTAGCTGTGTAACTTCCCCAT
```

Figure 20 (Continued)

```
TCCCACCTACTCTTCCCATCCTTTCCCAACTTTGGAGAAAACTCCCCAGTTTAGCCCCCTGACCTGCAGG
CTGTGTCCTGGCAGGTGTGGGAGGGAAGCCCATGGCCAGGTACCAGGGAGGGCAGTGAATGTCTTGCTCT
TCCCATGGGTACAGCCCACAGCTTCTTGGCTGAACGTAGAACTTCTTTTTCTCACCCAGTATACCAGCCT
CTTCCTGGTGATTCTGTTTTGCTGCTTTGGCAAGAACTACATTTTGTTTTTAAGAGAAATTTCTGAATAT
GAATGTGGAGAGCAAACACAAAAAGATTTAGGTTACGCCGGGTGCAGTAGCTCACGCCTGTAATCCCAGC
ACTTTGGGAGGCCTAGGCGGGTGGATCACCTGAGGTCAGGAGTTCAAGACCAATCTGACTAACACGGTGA
AACCCCATCTCTACTAAAACTACAAAACTTAGCCGGGCATGGTGGTGCGTGCCTGTAATCCCAGCTACTC
GGGGGGCTGAGACAGGAGAATCCCTTGAACCTGGGAGGCGGAGGTTGTGGTGAGCCAAGATCGTGCCACT
GCACTCCAGTCTGGGTGACAGAGTGAGACTCCGCCTCAAAAAGATTTAGGTTGCAAATGTTTCAAGCATG
TGCAGTTTTGTGTGTGTGTATACATATATATGGTCAGCATATATATTGTGCAGCTAGGGCGAAGCCAGCA
GAGGTGTGTGTATGTCTTTATGAAATGTTTGAAAAGAGATAAACTGACTGCTTGATAATCACTCTCAGGT
GTAAAGCTCCAAGTGTAAATAAAAGTGGCATTTAACAAATCTTTCAGAACAAAGTACAGCTGACTATATA
TACCAAGAGCTAAGCTAAAGGAACAGCTGAGAGCTCCGATCTCCACGAGAGACTAATCTAAAAGCTCTGC
TTTGTACTTCCTCACCCTGCTTTCGTACAAGGAAGGGGGACGATGGGAAATCATGGACTTGTAAGTTGTA
TTTAAACATAAAAATGAACTTGGTAACTTCTGGGTTTAGTAGAGCCTCAGTGTCGCTTTAACTTAGTTTA
CTTTTTTTTATTTTTAAAGCAGCAATGGATGGTTTTAAAGGAGTATTATGATTGTAAAATTGCTAAATA
TGACTGTAACACAGCTTTGTGGTAGCTGTGACACAGTTCACTTGGGCAAAGGAGTGGTGATGGACTCGTT
AAAATCATATATACTTGAATAGTCCATTGACCGAAACTCTTTATAGACTATTGTGTAAATGTGGAATCAC
AGACTGTTAACATTGCCTGGACTTCAGCAGAGTCCTGGAGCTGCTGGGACCTCTCCTATCATGATGAACT
TGGACTTTTTTTTTGATTTCTGGTTTTAAAAAACATAAAATTATAGAATCCAGATAATTCGCTGGAGTC
ATTCTGATCCACCATGTAGATCTGTATTTAGTATCATTTGGATTTGGAGAAGTGTTGATTACATTATGGC
TGTGTAATAAAATTTTTATTAAAACTGCATCACACTGTAGCCACTTTGCCACCACCTCCCCACATGTAGC
CGCTGAAACCCCCACGAGATGCCAATGCACACAGCAGGGAGAAAAGCCAACCAAAGAAGACCGAAGGGTA
TCTTTCCACCCGAGTAGCCTCTGTAGTGATTGGGACCAAGACTAAGGACTTGTCTCCAATCTCAGCTGAG
GCAGTGCCTCTGAACCAAGATCTTGGTCAGGCATTAAGACACTGGCTTTGTCCTACCAACTAGGATTTCT
TGGTGGTTCACACTATTTCTTGTGCTGGGGAATTCCCTCATTGGGCCCCTCCTCCCTCCACAGTGTGGTT
TCAGTGTTGAAGGGTGCAGCACCCAAGGTTGTTTTATGCATTTTTTCAGTTCCTTCCAAGAAGCAAAAA
GGCCAGTGTCCATCTGCCTAGTTCATAATGTTTATAGGTCTGTTTGTCTGTCTTGCTTCTGGCAGGTGTA
GGGAAAGTCTACTGCCTGCCACTCCCTTCAAAAAGAATGTTTTTGCTTTTGTGAAGTCCTGACTTGCCAC
TCAAACTGTACCAATATTGTAAATAAATGTTATGCCATTTTAACAAAGGGAAAAAAAAAAAAAAAAAA
```

>gi|212549564|ref|NM_015981.3| Homo sapiens calcium/calmodulin-dependent protein
kinase II alpha (CAMK2A), transcript variant 1, mRNA

```
GGTTGCCATGGGGACCTGGATGCTGACGAAGGCTCGCGAGGCTGTGAGCAGCCACAGTGCCCTGCTCAGA
AGCCCCGGGCTCGTCAGTCAAACCGGTTCTCTGTTTGCACTCGGCAGCACGGGCAGGCAAGTGGTCCCTA
GGTTCGGGAGCAGAGCAGCAGCGCCTCAGTCCTGGTCCCCCAGTCCCAAGCCTCACCTGCCTGCCCAGCG
CCAGGATGGCCACCATCACCTGCACCCGCTTCACGGAAGAGTACCAGCTCTTCGAGGAATTGGGCAAGGG
AGCCTTCTCGGTGGTGCGAAGGTGTGTGAAGGTGCTGGCTGGCCAGGAGTATGCTGCCAAGATCATCAAC
ACAAAGAAGCTGTCAGCCAGAGACCATCAGAAGCTGGAGCGTGAAGCCCGCATCTGCCGCCTGCTGAAGC
ACCCCAACATCGTCCGACTACATGACAGCATCTCAGAGGAGGGACACCACTACCTGATCTTCGACCTGGT
CACTGGTGGGGAACTGTTTGAAGATATCGTGGCCCGGGAGTATTACAGTGAGGCGGATGCCAGTCACTGT
ATCCAGCAGATCCTGGAGGCTGTGCTGCACTGCCACCAGATGGGGGTGGTGCACCGGGACCTGAAGCCTG
```

Figure 20 (Continued)

```
AGAATCTGTTGCTGGCCTCCAAGCTCAAGGGTGCCGCAGTGAAGCTGGCAGACTTTGGCCTGGCCATAGA
GGTGGAGGGGGAGCAGCAGGCATGGTTTGGGTTTGCAGGGACTCCTGGATATCTCTCCCCAGAAGTGCTG
CGGAAGGACCCGTACGGGAAGCCTGTGGACCTGTGGGCTTGTGGGGTCATCCTGTACATCCTGCTGGTTG
GGTACCCCCGTTCTGGGATGAGGACCAGCACCGCCTGTACCAGCAGATCAAAGCCGGCGCCTATGATTT
CCCATCGCCGGAATGGGACACTGTCACCCCGGAAGCCAAGGATCTGATCAATAAGATGCTGACCATTAAC
CCATCCAAACGCATCACAGCTGCCGAAGCCCTTAAGCACCCTGGATCTCGCACCGCTCCACCGTGGCAT
CCTGCATGCACAGACAGGAGACCGTGGACTGCCTGAAGAAGTTCAATGCCAGGAGGAAACTGAAGGGAGC
CATTCTCACCACGATGCTGGCCACCAGGAACTTCTCCGGAGGGAAGAGTGGGGGAAACAAGAAGAGCGAT
GGTGTGAAGAAAAGAAAGTCCAGTTCCAGCGTTCAGTTAATGGAATCCTCAGAGAGCACCAACACCACCA
TCGAGGATGAAGACACCAAAGTGCGGAAACAGGAAATTATAAAAGTGACAGAGCAGCTGATTGAAGCCAT
AAGCAATGGAGATTTTGAGTCCTACACGAAGATGTGCGACCCTGGCATGACAGCCTTCGAACCTGAGGCC
CTGGGGAACCTGGTTGAGGGCCTGGACTTCCATCGATTCTATTTTGAAAACCTGTGGTCCCGGAACAGCA
AGCCCGTGCACACCACCATCCTGAATCCCCACATCCACCTGATGGGCGACGAGTCAGCCTGCATCGCCTA
CATCCGCATCACGCAGTACCTGGACGCTGGCGGCATCCCACGCACCGCCCAGTCGGAGGAGACCCGTGTC
TGGCACCGCCGGGATGGCAAATGGCAGATCGTCCACTTCCACAGATCTGGGGCGCCCTCCGTCCTGCCCC
ACTGAGGGACCAGGCTGGGGTCGCTGCGTTGCTGTGCCGCAGAGATCCACTCTGTCCGTGGAGTGGAGCT
GCTGGTTCTCCCAGGTGGATTTTGCTGGAATTCTCCCATGTCATCACCCCACCACCGTCACTTCTGTACC
TGCATCAAGAAAACCTGCTTGTTCACAAAAGTCATCGCAACTTCAGAGCGAACGGCCACATCTCCCCACC
TCTCACCCCCACCCTCTCCCCTGCCAGGCTGGGGCTTCCTCAGGCATGGGTGTCCACAGCACTGGCCCCC
TCTCCCCAGCCTCAGCTGCTGTCCGCCTGATCTGTCTTGGGCTGTAGGCTAGAATGCCCGGGCTGGTGCC
CACCAGGGGCTGGGGAGAAGGAGGGGTGGCATGATGAGGAAGGCAGCATCCGTCCGTCCCTCTCCCAGAC
CTCTCCTCTTCCAGTGTCCCCGGGGAAGGGCAGATGACACTCCCTTCCCCCTAAGCCAACCGCACTGAAG
GAGTGGGGAGAAGAGCATACGCCAGGAGCCTCCTGCCTCAAAGTGCTCCCCTAAGTCTTCTTCCTCCTGT
GCTGACCTCAGGGTGGTCTGACCCTTCCCTCGGTGTGGGGGATGTGGCCCTCTCAGGTGCCCCTACTTGC
TTTCTGCTTCCTTCTGGTGAAGTCCACCTCCAACATTAACCTGCCCACCCCACCCCCGTCATCCCTGGAG
AATTCCAGCTTTGTCGTATCTCAGAGAGGGAATCTAATTGTTTTGGGGGGCAAAAGAAAGCAACGTTTA
GGTATCACTTCTACTTGGACCGCATGCCTTTTTATAGCCAAATTTCTGTGTATTTCGTAAATGGATTTCG
CGTTAATGGATATTTATGTAATAACTAGACTTCTCAGATTATTGTGAGAAGGGTCAGGTTGGAAGGGGTG
TAGGAAGAGGGGTGAGGGGTAGTTTTTTTCTGTTCTAGTTTTTTTTTTTTTTTGTCATCTCTGAGGTG
GACCTTGTCACCTGTGGTTATTGGGGCCAAGGTGGACTCAGCTCCGGGGAGAAGGGCCTCTCTGCCATTT
CGGTCCCAAGGTGAGCTGACACAGGCGTTCCTTTTGGGACTGTGGAAGCATCAGATGCCAGCACTGACTC
AGGAACAGCAAGTCAGGGCAGAGAGGAGGAGGGAGGCTGTCAGGATGGAAATACCTGGACTTTTCTTTGC
TTCCCTCGCAAACTGGGGTCTTCTCTACCGAACTTCCCAGGATTTCATCTCACCATATCTGTGTGCCGCC
CCCAGCACCCCCACCCACCTCTGGGGGCCCGTGAGCGTGTGTCTTCATTGCCTCTCTCCCCTTGGCGT
CTGATGACCACAGCAAAGCACTGGGAATTTCTACTCTTCATGCCTCATCCTGCAGCCTCGGGTTCGCATT
CTCTCTTTCTTTTCCTCTTTCCCTCTTTCCCTGGGATTGACTCTGAGTGGAATACCTTGGCACATCCACT
AGGATCTACTGTCTGCACTGTTTTCTTTGCATGACTTTATACGCAGTAAGTATGTTGAAAACAAACAAAA
AGAAGAAAACACTCAACAAAACCAATCTACATGTTTTGGACTAAAAAAAAAAATAGAGGTTGTATTCTCA
GTGTCCGACTCGGAATTATGTTGCTGCCTCTCTGTGCTTTTGGCCTCTGTGTGGCCGTGTTTTGCCAGCA
TGAGATACTGTCCCCTCTGGAGGATTTTAGGGGAGGAAGAGCCACGTCCCCAGGGATTGGAGGAGGCTCC
GGTACCCTCGACCCTCCTGGGTGTTGGTTGGAGCAGAACTGGTGAGGATGTTTGATCCGAGATTTTCTGA
GCTCTCCCCAATCACCAGCTGTCTGCTGGGTTCTTTTCTCAAGTCCTGCTGCCCAGGCCCAGGTGAGACA
```

Figure 20 (Continued)

```
GGCAACGCCAGGTCTGCAGGCCAGGAGAGATGCTGCCCAGGCCTCCTGGTTTCCAAGCTGGTCCATCACT
GGCCTCTGTCCTTGGCAGAGACCTTGCTGCCCAGGCCCAGGGGCAGGCTCTTGGCCTGCCCCAGGCCCAG
AGGGCTTCCCAGTAAGGCCCAGTGATCCCATTATCCCAGGGGCAAAACCACCTGTCCCCTTTTGAGCTGC
CAGTTCCCTACAGCCATCCCCAGTCAAGGGTGAGGGTGTGGCCTTCACCAGGGGCTGCTGTAATTACCGA
GCAAGGTCTGAGCTCTTCTTCAGCCTCAGTTCCCTCATTGGTTAAAAGGGTTCTTTGTTCCCATCCAGCC
GATGAAGGAGCAAACGTCTGGCTATGTGAAGCCTAATTTACCTGCAGGAACTGGCAGGGATAGTCACTGG
CTGGACTCCTGTTTACTTCTAGACCTGGTCAGGCTCCATCCCCTCCCCACCTGCCCCTGATTCCCCTCG
TCGGTGCCTGTCAACTGCTTTTCAGCAGTGGACTGCAGGGGAAAGAGCAGTGATTTGGGGTGAGTAGGCT
TCAATTCCCAGCTCTGACCAGACTTGCTGTGTGACCTTGGGCAAGTTCCTTTCCCTCTTTGGAGCTTGGT
TTCCCTGCCAGAGGAAACTGAGCTGGAGGAGCCTGAGGTCCTGCCTTTCATTGGCTGACACACCTCCTGT
CCACTGTGTCACTCTCCAAGTGCCAGAGAAGTGGAGGCAGATCGCTACCCCAGGCTGAGATGGCCCCCAC
TGTGAAGGCCACGCCTGTGGGTGGGCAGCCACCTGGTGCCACCACAGGGCACCAGGGATGATCCTGATGT
GGCAGGCAGGGGAGACTCACAGAAAAATCTGCCCAGAGCCTACCCTCACCAGACAAACTCTGTGCTCCTC
CAAAACATCCTTTAGATGCAAAATAATAATAATAATAATAATAAATAAATAAATAAAAATCCAAACCCAA
GTCAAAACCTTGGCTCCAGCATGAAAACACGTTTACAGGAAAGTGTTCTCCTGGGTTTGTGCCCACCATG
GTGCGAATCCTGACCCAAGGCCTCCTGTCTCCCTTCAAAGGGAGACCCTTTTGGGGGATGAGTTTGCCAG
ACTCCCCGTGCTGGTTTCTTTGTTACTATTTGTTTGGGGTTTTGTTTTAGTTCTTTTTTTTTTCTTTTC
TTTTTTAAAAATATGTGGCTGTGAACTTGAATGAACACTGCTCAAACTTTCTGCTATTGGGGGGGCGGG
TGGGATGGGAAGAAGGGGCGTTTGTTTTATTCTTGGTGTTTTCAGTGCAATAAATAGCTACAAACTTCTG
TGCAAAAAAAAAAAAAAAA

>gi|223671881|ref|NM_016123.3| Homo sapiens interleukin-1 receptor-associated
kinase 4 (IRAK4), transcript variant 2, mRNA
CCCGCCCCTTCGCGGCGCTTCCTAGTTCGGCTGGTTCTTCTGTCGCCGGCTTCAGCAGCCCGCGCCCGGG
CAGGAATAGAAGATGAACAAACCCATAACACCATCAACATATGTGCGCTGCCTCAATGTTGGACTAATTA
GGAAGCTGTCAGATTTTATTGATCCTCAAGAAGGATGGAAGAAGTTAGCTGTAGCTATTAAAAAACCATC
TGGTGATGATAGATACAATCAGTTTCACATAAGGAGATTTGAAGCATTACTTCAAACTGGAAAAAGTCCC
ACTTCTGAATTACTGTTTGACTGGGGCACCACAAATTGCACAGTTGGTGATCTTGTGGATCTTTTGATCC
AAAATGAATTTTTTGCTCCTGCGAGTCTTTTGCTCCCAGATGCTGTTCCCAAAACTGCTAATACACTACC
TTCTAAAGAAGCTATAACAGTTCAGCAAAAACAGATGCCTTTCTGTGACAAAGACAGGACATTGATGACA
CCTGTGCAGAATCTTGAACAAAGCTATATGCCACCTGACTCCTCAAGTCCAGAAAATAAAAGTTTAGAAG
TTAGTGATACACGTTTTCACAGTTTTTCATTTTATGAATTGAAGAATGTCACAAATAACTTTGATGAACG
ACCCATTTCTGTTGGTGGTAATAAAATGGGAGAGGGAGGATTTGGAGTTGTATATAAAGGCTACGTAAAT
AACACAACTGTGGCAGTGAAGAAGCTTGCAGCAATGGTTGACATTACTACTGAAGAACTGAAACAGCAGT
TTGATCAAGAAATAAAAGTAATGGCAAAGTGTCAACATGAAAACTTAGTAGAACTACTTGGTTTCTCAAG
TGATGGAGATGACCTCTGCTTAGTATATGTTTACATGCCTAATGGTTCATTGCTAGACAGACTCTCTTGC
TTGGATGGTACTCCACCACTTTCTTGGCACATGAGATGCAAGATTGCTCAGGGTGCAGCTAATGGCATCA
ATTTTCTACATGAAAATCATCATATTCATAGAGATATTAAAAGTGCAAATATCTTACTGGATGAAGCTTT
TACTGCTAAAATATCTGACTTTGGCCTTGCACGGGCTTCTGAGAAGTTTGCCCAGACAGTCATGACTAGC
AGAATTGTGGGAACAACAGCTTATATGGCACCAGAAGCTTTGCGTGGAGAAATAACACCCAAATCTGATA
TTTACAGCTTTGGTGTGGTTTTACTAGAAATAATAACTGGACTTCCAGCTGTGGATGAACACCGTGAACC
TCAGTTATTGCTAGATATTAAAGAAGAAATTGAAGATGAAGAAAAGACAATTGAAGATTATATTGATAAA
```

Figure 20 (Continued)

```
AAGATGAATGATGCTGATTCCACTTCAGTTGAAGCTATGTACTCTGTTGCTAGTCAATGTCTGCATGAAA
AGAAAAATAAGAGACCAGACATTAAGAAGGTTCAACAGCTGCTGCAAGAGATGACAGCTTCTTAAAACTT
TATTGGAAAAGACTCTTGACTTTTTATATACACCTATCTCAACCATTTTTTTAACTGATTTTTTTCCTAA
ATATTCTTCTTTACCTTTAACAAGGCATAGGCTGTTGCAGGACAGTGGTTATTAAAGCATGGGTTGAACT
TCCAAAATATAAAAATAGAGCCACCATATCAACACTTAGCCCTACCCATTAGTATCACCCCCAGTTCTTA
CAGTAATCCCTGAGAAATCTCCTTCAAGCATCACCAAACACAGTTTGAAAATTACAGGGTTAGCAAAAAG
AGCCTGGGCTGTATGTAGGGTGGAAACACTCTGATCTGAAGCCCAGCTGACTCCACTACTAATTTGCTGT
AAAGCTTTGGACATACACTTAGCTGCTGTGAGCCACTAATAACATTGGGCTAATATCTGCTGTGCTTCTC
TGACAGGTAGTCATGAAAATCAAATGATGCAAATATATACAAGCACTTTGTAAATTGTAAAATGATACA
AAATTTAAAGTTTATAGAGCCAGTTACAAAATCCTATTAGTCATATATTTATAGATTGTGTTCACAGCAA
TCATTTAACCACAAATAAAATATCCCTTGATGATACTGCCATAATGATATGTCCATTATTAGATTATGTT
ACATGACAAAGTTGAAGGAATTTGGCAGATGCAGTTAAGGTTCCTAAACAACTCACTTTGAGACTGTTGA
AAGGGCCTGACCTAATCAAGTGAACCCTTGCAAGAAGAATTCTCCTTGTAAGCCTTGAAGAAGTATGTGA
GAGGGCCACATTGGCTAAAACCTAAAGGTGGCCTCTAGGAGATGAGACCTACCTTCCAGTTGTCAGCAAG
CAGGAAAAAAAAATTGGGACCTCAGTTGCAACCACAAGGAACTGAATTCTGCCAAAAATCTGAGTCAGCT
TAGAAGAGTACTCCAAGCTTCAGATGATAACCACAGCCTGGGCTGACACCTGGATTTCAGCTTTGCATGA
TCCTCAGTATGAGAATCTATCTGTTCTGTGCTGGACTTCTAATATATAGAACTGTGAGATAATGGGTCAC
ATTGGCTGGATGTGGTGGCTCATACCTGTAAATCCCAGCACTTTGGGAGGCCGAGGCAGGCAGATCACCT
GAGGTCAAGAGTTCAAGACCGGCCTGGCCAACATGGTGAAACCCCGTCTCTACTAAAAATACAAAAATTA
GACGAGCGTGGTGGTGGACACCTGTAGTCCCAGCTACTTGGGAGGCTGAGGCAGGAGACTAGCTGGAACC
AGGGAGGTAGAGGTTGCAGTGAGCTGAGATCGTGCCACTGCACTCCAGCCTGGGTGACAGAGTGAGACTC
CATCATAAATAAATAAATAAATAAATGGGTCACATTAAGCCTTTAAGTTTGTGGTAATTTATTATTCAGT
AATAGAAAACAAATACAGATACTCTCCCATGATGTTTTTCCCATGATGATTTCCCATGATATTTACAGGT
TTTGCCCACATTTGAGGGGTATGTGGAAATTATACAGAGCATGTACAGCGGGAGGCTTATAGTGTACGTA
CTGAAATGTGGGGTTGGAGCCCCAACACAGAGACCCCAGCAGGACACTGCCTAGTAGAGCTATGGGAAGG
GTGCTGCCACCCTCCAGACTTGAGAATTGTAGAGCCACCAGCAGCTTGCACTCTGAGCTTGGAAAAGCCA
CAGGCACTCAACTTCAACCATGAGGGAAGCCACGCACCCTGCAAAGCCACAGGAGTGGAGCTGCCCACGG
CCTCGAGGGCCCACCCCTTGCACCAGTGTGCCAGGATGTGGGACATGGAATCAAGGAATATGTTAGGGCT
TTTTTTTTTTTTTTTTGAGACGGAGTCTTGCTCTGTTGCCCAGGCTGGAGTGCAGTGGCACGATCTCGG
CTCACTGCAAGCTCTGCCTCCCAGGTTCACGCCATTCCCTGCCTCAGCCTCCCCAGTAGCTGGGACTAC
AGGTGCCCGCCACCATGCCCAGCTAATTTTTTTGTATTTTTAGTAGAGATGGGGTTTCACTGTGTTAGC
CAGGATGGTCTTGATCTCCTGACCTCGTGATCACCCGCCTCGGCCTCCCAAAGTGCCAGTATTTAAAGTT
TAATGTCTTCCCAGCTGGGTTTCAGACTTGCCAGGATCCTGTTGCCCCTTTCTTTAGCCAATTTCTCCCT
TTTGGGACAAGAATGTTTTACTTATTGCCTGTACCACCAACTGTATCTTGGAAATAAATAACTTATATTT
TATTTCAGAGGCTCATAGGCGGCAGGAACTTACCTTGAGTCTCAAATGAGACTTAGGACTTTTGAGTGAT
GCTAGAATGAGTTAAGACTTTGGGAAGGGATGATTATATTTTGCAATGTGAGAAGACATTAGATTTGGG
GGGCTGGGGGTAGAATGACATTGTTTAGATGTTTGTCTCCTTCAAATTTCATGTTTAAATGTAATCCCCA
GTGTTGGGGGTGGAGGTGGGGCCTGATGGGAAGTGTTTGGGTCATGGTGGATGATCCCTCATGAATGGCT
TAGAGCCACTGGTGATGAGTGAGTTCTCACTCAGTTCGTGTGAGATCGGTGGCTTAAAAGAGTCTGCTC
CCCCTTTGCCTTCCATTGTGATTGTAACCTTCCTGGGGCCTTCATCAAAGGCCAGGCAAATATTGGTGCC
GTGCTAGTATGGCCTGCAGAACCGTAAGCCAAAACAAACCTTTTTTCTTTATAAATTACCCAGCCTCAGT
TATTCCTTTATAGTGATGCAAAACGGGCTAACTATATAAATTTGTAATTTTAAGTTATAGATTGTTTTT
```

Figure 20 (Continued)

ATTAAACACTTATGAATACTGTTAAAAAAAAAA

>gi|205277436|ref|NM_017583.4| Homo sapiens tripartite motif containing 44
(TRIM44), mRNA
GGAGGCTGAGCGGGCGGCGCGACGCGGGGGCCGACGGGGGCGCCGGGTGGCCGCGCCGGAAGTGCCTTGC
GCGGCAGAGGAAGCGCAGGGACAGAGCGGAGCAGGCCGAGCCGGCGGAAAGGGTCTTTGCTGCTGCGCCC
GGGCAGGGGCTGCCGCGGCCCCAGGTCCCGCTTCGAGACGCGGCGCGGTCCAGGCGGGAGGCGACTCCCT
AGGAAGGGACCCGGGGCGGGAGGAGGAAGTGAGGCCGCGCGGAAGGAAGGCGGCGAGCCCCGGGGCCCCG
AGGCCTTGGCCGCGTCACAGCACCCACATGGCCTCTGGAGTGGGCGCGGCCTTCGAGGAACTGCCTCACG
ACGGCACGTGTGACGAGTGCGAGCCCGACGAGGCTCCGGGGGCCGAGGAAGTGTGCCGAGAATGCGGCTT
CTGCTACTGCCGCCGCCATGCCGAGGCGCACAGGCAGAAGTTCCTCAGTCACCATCTGGCCGAATACGTC
CACGGCTCCCAGGCCTGGACCCCGCCAGCTGACGGAGAGGGGCGGGGAAGGAAGAAGCGGAGGTCAAGG
TGGAGCAGGAGAGGGAGATAGAAAGCGAGGCAGGGGAAGAGAGTGAGTCGGAGGAAGAGAGCGAGTCAGA
GGAAGAGAGCGAGACAGAGGAAGAGAGTGAGGATGAGAGCGATGAGGAGAGTGAAGAAGACAGCGAGGAA
GAAATGGAGGATGAGCAAGAAAGCGAGGCCGAAGAAGACAACCAAGAAGAAGGGGAATCCGAGGCGGAGG
GAGAAACTGAGGCAGAAAGTGAATTTGACCCAGAAATAGAAATGGAAGCAGAGAGAGTGGCCAAGAGGAA
GTGTCCGGACCATGGGCTTGATTTGAGTACCTATTGCCAGGAAGATAGGCAGCTCATCTGTGTCCTGTGT
CCAGTCATTGGGGCTCACCAGGGCCACCAACTCTCCACCCTAGACGAAGCCTTTGAAGAATTAAGAAGCA
AAGACTCAGGTGGACTGAAGGCCGCTATGATCGAATTGGTGGAAAGGTTGAAGTTCAAGAGCTCAGACCC
TAAAGTAACTCGGGACCAAATGAAGATGTTTATACAGCAGGAATTTAAGAAAGTTCAGAAAGTGATTGCT
GATGAGGAGCAGAAGGCCCTTCATCTAGTGGACATCCAAGAGGCAATGGCCACAGCTCATGTGACTGAGA
TACTGGCAGACATCCAATCCCACATGGATAGGTTGATGACTCAGATGGCCCAAGCCAAGGAACAACTTGA
TACCTCTAATGAATCAGCTGAGCCAAAGGCAGAGGGCGATGAGGAAGGACCCAGTGGTGCCAGTGAAGAA
GAGGACACATGAAGGCTTGCTACCCCCAGTGGAAAATCATCCCCTCCCCTTGTGTGTATGTGACAGCGTG
TATGTAACGGCTTCTGATTTCTGTGAAAGCTGCTCAGCAACAAACGTACTTCCACCAGATGTGTCCCCAG
ATCCACAGCAGGCACATATCTCTCCAAGGGATGACCAGTTTTATGCTTACTGTGTGCTTCTCATCCCCTG
GTTGTGGTAGGTCAAGGAAAAGAGCCCCTTTGATCCACCAGGAGCAATTAAGAAAGGTCCTTCAGGTAAT
CCCTCAATGGCTGCTTTGAACTTACTCAGGAAAGCCAGCCCCCATAATATTGTATTACCAAACAGTATCG
CTTTGTTAGGAAGGATCTGGAATAATCTTGAAGGGAAGTCAGAGTTTTCTCCCTGCCTATTAACAAAAAC
CCAATTTTGTTCATATTGAAGCATGAAATAAATGAGAGCAAGGTAGGGCCAAATTAACTCTTGTGGACAG
TCCCTAAAAGTCCAGTTCTACATTTGTGAAAATTGTGGTGCCATGAATTAAGATGGATGACTGGAAAAAG
GTGTTGGAGAAAGAGTTAAAGATGAGGAAGAGATATTTTTAGTATATGAAGTTATCCAGGACTTGATATT
CATAATTCAGTGCTGTGGAAATGAAAAAAATGATTGAAGAGGTGGAACGGAAATGACCTTAGGGGAAAA
AAAAGGACCAAAGAAGTCTGATTAAAAGTTGAAATCAGTATTTCTGAATTCAAATTGCTTGAATTTCCAA
AATAGTCAGTAAAGGATCTAATAGAACCAGAATTATTTGGGTGAATTCTGCAGGTTTTATGGGCTTGTCA
CAACGTGAAGGGCTGGAATGTATATTACCAAATGGGAATTTCCATTGTAGGTTTTTGCTAGTCCCACCCC
CATTTTAGCCTAATTTGGCTTAAACGCAGTATGGGAGAATTGTTCCCATTCCATGTGTTCTGAATTCAG
CTCATCTCCCAGCATATAGATATATCCTCCTTTAACTCCGACCAGAACCCTTCTTCCTGTGGCACTCCCC
ACCCATAGACCTTCAGATCATCTCCCACACCCTGGATCTCACTCTCCTCTTAGTAACAGAGACACTCCTG
AGGTTGGACTTCCTTGCTTTTCTCTACTTCCAAATCACAATTTCTTACAACCAAGCTTTGTGCTCCCGAG
TAAGCAGGGATGTACTAGGGGAATGTAAAACTGCAAACTTAAAAACCTGCATCTTCTTGAAGCATCAGTT
TTACTTACCAAATGGTTTAGAGTCATAAGATGACCTATTTTTATATAAAAGTTATATTATAGAATAAAT Figure 20 (Continued)

```
GTTCATACGCATAGACTGTTAAGATAAAAAAATAGGAATCTTGCAAGGTAATTCTTATTTGCAAGTGGGT
TATGTGTTCACTCTCCTCTACCTTTATGGTATTTTGGTGTTCACTTACGAAGCATACAACTAGAACCATA
TCCAAGCAGACTCTGGGTTGCTGTTAACCCAGGGCCTAGACTTCTAGTGCCTCTGAGGCAGAACCAAAGG
AGCCTGCACTGGGGGAAATCCCTTTTCCTGCCTGCCTGTCTGCCTGTGACCTGTGTACGTATTACAGGCT
TTAGGACCAGCTGATTGTTATGCTTGCAGGATGGTTTTGAAACAGAAACAATACTTGTTTACTGTAGGAA
TCCTATTTATATTATTTTTCAGTCCTGTGAATGCTGTGAAAAGATTTATTCCTTTGAGGCCAGGAAGCTC
CCAGGCATATATGCTTCTAGGTTAGGATTGTCCTGACTCACTAAAGATGCCAGGATATTGGGCTGAGGG
GAGTTTGAGGTGTTAAAAAAAAAAAAAAAAAAGCATTTTTCTCTCAAACTGATGGCCAAGAAATGGCTAG
GACAATTTTGGTGCTTTACCTATCTCTGCAAAGACTGGAGAATTTGGCATACCATTAATTACAACCACCA
ATCATATCCAACAAAAGTACCCTAAAAGAAGGACCAGTGGCCACTCTCGAAAAAATTTAAGTATCAGAAG
ATTAAAAAGATTTTAGGATTTGGAAGCTTGTATTGTCTTTCCCCAATAATCATTGTTTGATCTCCAAATA
GTAGCCTTATATTAGCAATAGACAGATCATTGGTTCTCCATATCTGATCATATGTTACTACTTTGAATCA
GTATTTGGGAAATTCAAGCATTTATGCAGTGGATATAAATGGAAATATAAAAATATTTGCCAACCTGTCT
CAGTAACTTATCATATCTCTGTGATCCTCAAGGAAAGCACTTTTGCTTTTACTTAGAAAGCGTTTCAGAT
TTGCTTTATAGACTCCTGCTGTCTTCAGTACCTGATAAAACTTTAACCAGGGAAGCATTAAACACAGTGC
AGCAGCTTTTGCCCAGGCTTCTAAGTTCCTGCCGGCAGCATTTATCAATGTAAGAACTAGGATGCTTCCT
GCAGTGGCACTACCTTCCCCTAGAGCTGGAGCATGCTGCTTGGCCTTAAGCCCCAGCATGATGAGGCTTC
CCTCCTGCCAGGTCAGTAAAAGTTAGAGAGCTCAGAATTGGGTCTTGCCTGGGTGCAGGTGGCAGGGTTT
GCTGAAACCCCTAAAGAGAAGTCACCAAGGGAGGCAGGTAATGAATGTTTCCAGAATCAGTCGGATACTC
ATAGCAATTTCTGGCTATCTTTCAAATGTTGAATTTCTGGATGCTGAGAGGGACTTTGATTTGATATCAT
TAAATCCAGGACAGTCCCAAGAAGTGCTTGGAGTCTCGGCTCTGACAGCCCAAGAAGGGAAATAACTTGT
ATTAAGGAACAACTATGAGCCAGGCCCTGAGCTGTCTCTTAGATAATAAAACAGATGGGGAGTGGAAGAG
TCATTTGCTTCAAGTTATACAGCTAGGAAATACTCAAGCCAAATCTTGAACGCAGCTCCCCCTAATTCTG
TGGACAGGCACTTTGTACCACACACCATGGTCCACCTAAAAACAGAAGGATAAAAAGACTTCAGGTT

>gi|8923664|ref|NM_017949.1| Homo sapiens CUE domain containing 1 (CUEDC1), mRNA
AAGTGTGGCCACTTCCTCTTGCCTGTCCTGACTCACCCTGGCTGCTGCCCATTGTGGCTGCCATGGAAAT
ACAACTCGAGGAGAACCCAGACCAGGACAGGGAGGCCATGTTCTGGGTGGCAGTGGAGCCTGGCAAGGTG
CCCTCCTGGCCTGGGACTGCTGTGGCAGAGGAAGCATGAGGTGGGGCCTGGCCTGCCCAGCTCAGAGCTG
AGGTGCCCCCTTGGTTTTTTACCTCCCTGCTCCCTGGCTGGCCCACTGCACCCACGCACTCAACGCAGTG
GCTTCGCTCCTCCTCCAGGATGGCTGGAGGTGGACCATTGCCAGGATGGCCTCAAGTGCCCAGCCCTCC
TGGAAGACTCAGTTTCCCTCTTTGTCCCATGCAGAGGTGCAGAGATTCATTATTGTGGGACCATCCGTGA
AACCGGTGCCAGGATGCACCGGGGGTGTGGATGACCGGCCGCCCAGCCCCAGCACGGCCCGGTCCCGCAT
GCCACCGCCCCGCGAGGACCGCTCTCCAAGGGCTGCCTGGGGCCCCGCGCCCGTACTCTCCTAACCCGGA
GCTCTTGGCAGCCCATTGCTGCCTGGCTACCCGGGGAGGAGGAGGCGCAGGAGTGAGCTGCCCGAGACCG
CAGGGCAAGTAAGCGGCTGACGGCGGAAAGACCCTGGGGAAGGGCTTTGCGGCCGGCTAGAAACATTTT
CCCCAAGCGGCTCCGCAAAATGACCAGCCTGTTCCGCCGGAGCAGCAGCGGCAGCGGCGGGGTGGCACC
GCCGGGGCACGCGGGGCGGGGAGGCACGGCCGCCCCCAGGAGCTCAACAACAGCCGGCCTGCCCGCC
AGGTGCGCCGCCTGGAGTTCAACCAGGCCATGGACGACTTCAAGACCATGTTCCCCAACATGGATTACGA
CATCATCGAATGCGTGCTGCGCGCCAACAGCGGCGCTGTGGACGCCACCATCGACCAGCTGCTGCAGATG
AACCTGGAGGGCGGTGGCAGCAGCGGCGGCGTCTATGAGGACAGCTCCGACTCGGAGGACAGCATCCCCC
CGGAGATCTTGGAAAGGACTTTGGAACCTGATAGCTCGGATGAAGAGCCCCCACCTGTGTACTCCCCGCC
```

Figure 20 (Continued)

```
AGCCTACCACATGCACGTGTTCGACCGACCCTACCCTCTGGCTCCCCCGACTCCGCCTCCCCGTATCGAC
GCGCTGGGCTCTGGAGCCCCTACAAGCCAGAGACGCTATCGGAACTGGAACCCACCACTGCTGGGCAACC
TTCCGGATGACTTTCTCCGCATCCTGCCCCAGCAGCTGGACAGCATACAGGGTAACGCTGGGGGCCCCAA
GCCTGGGAGTGGAGAGGGATGTCCACCTGCCATGGCTGGGCCAGGGCCCGGAGACCAGGAGAGCCGCTGG
AAGCAGTACCTGGAGGACGAGAGGATCGCGCTTTTCCTGCAGAACGAGGAGTTCATGAAGGAACTGCAAC
GGAACCGCGACTTCCTCCTCGCTCTGGAGAGAGATCGATTGAAATACGAATCCCAGAAATCTAAATCCAG
CAGCGTGGCTGTCGGAAACGACTTTGGCTTTTCCTCTCCTGTCCCAGGAACTGGCGACGCCAACCCCGCT
GTGTCTGAAGATGCCTTATTCAGGGACAAGCTGAAACACATGGGAAAGTCCACCCGGAGGAAACTGTTTG
AACTTGCCCGAGCCTTCTCAGAGAAGACCAAAATGAGGAAGTCAAAGAGGAAACACTTGTTGAAGCATCA
GTCGCTGGGGGCTGCCGCGTCAACAGCCAACCTCCTGGATGATGTGGAGGGCCACGCGTGTGATGAAGAC
TTCCGGGGCAGGCGTCAGGAGGCACCCAAGGTGGAGGAAGGCCTGCGAGAAGGACAGTAAGAGATGCCAG
CAGCTCTTCCTTGCCAGAGATGATCTGACCCGGTGGGGGCAGCTGGAAAGCAACACTGGCCCCCAGCTGA
AGGGCCCAGCTGCAGCCAGACAGATGGTGCTTGAGAACCGAGGCCCGGTGATCCTCCAGCCACAGTCCAG
CCCAACCACTGCCACTTTCCATGGGACTTAGAACTTCGGAGTTGCTGCCTTGCAATTGGAGGAAGGACCT
GGGGCCCCTATAGGCAGCAGCCAATTACAGCCCCTTTTGTAGCCGGGCGTTCCTATGGTCAAAGAGTGGA
AATGCAGGAACCAACCTCCCTTT

>gi|41393557|ref|NM_018032.3| Homo sapiens LUC7-like (S. cerevisiae) (LUC7L),
transcript variant 1, mRNA
GAAAGAGCCGAGTGGGCTCGAGGCCGACGCGACCATCGTTTGTCGACGCCGCTGCCACCGCCTGCCTGAG
AGAAGTCGTCGCGGCCGACCCCGTCGCCTCCGCCGGCTACCATGTCCGCCCAGGCGCAGATGCGGGCCCT
GCTGGACCAGCTCATGGGCACGGCTCGGACGGAGACGAAACCAGACAGAGGGTCAAGTTTACAGATGAC
CGTGTCTGCAAGAGTCACCTTCTGGACTGCTGCCCCATGACATCCTGGCTGGGACGCGCATGGATTTAG
GAGAATGTACCAAAATCCACGACTTGGCCCTCCGAGCAGATTATGAGATTGCAAGTAAAGAAAGAGACCT
GTTTTTTGAATTAGATGCAATGGATCACTTGGAGTCCTTTATTGCTGAATGTGATCGGAGAACTGAGCTC
GCCAAGAAGCGGCTGGCAGAAACACAGGAGGAAATCAGTGCGGAAGTTTCTGCAAAGGCAGAAAAAGTAC
ATGAGTTAAATGAAGAAATAGGAAAACTCCTTGCTAAAGCCGAACAGCTAGGGGCTGAAGGTAATGTGGA
TGAATCCCAGAAGATTCTTATGGAAGTGGAAAAAGTTCGTGCGAAGAAAAAAGAAGCTGAGGAAGAATAC
AGAAATTCCATGCCTGCATCCAGTTTTCAGCAGCAAAAGCTGCGTGTCTGCGAGGTCTGTTCAGCCTACC
TTGGTCTCCATGACAATGACCGTCGCCTGGCAGACCACTTCGGTGGCAAGTTACACTTGGGGTTCATTCA
GATCCGAGAGAAGCTTGATCAGTTGAGGAAAACTGTCGCTGAAAAGCAGGAGAAGAGAAATCAGGATCGC
TTGAGGAGGAGAGAGGAGAGGGAACGGGAGGAGCGTCTGAGCAGGAGGTCGGGATCAAGAACCAGAGATC
GCAGGAGGTCACGCTCCCGGGATCGGCGTCGGAGGCGGTCAAGATCTACCTCCCGAGAGCGACGGAAATT
GTCCCGGTCCCGGTCCCGAGATAGACATCGGCGCCACCGCAGCCGTTCCGGAGCCACAGCCGGGGACAT
CGTCGGGCTTCCCGGGACCGAAGTGCGAAATACAAGTAACTACTCTGACTCCTTCGGTAGCTGCAACCAG
GAGTGAGCCCTTCTCTGTGTTCCCAGGGTCTGCTGAGGGCCGTGTCTGGTGGGGATGGGGCTGGGCTCAC
CCTCAGGAGTAGGGCTGGGGAGTCGTGAACGGGACTCAGGTGTGGGAAGAGGCGAGAGGGCTGTGGAGGA
GCTCGCACGGCGCCAGGTGATGGGCTGCACAGGCACTGTCCCCTGCCTGCGTCCTGGGGCCTGTGCACTG
TTGCGTCCATGCTCAGAGTGGCTGAGACTTGTGTCCTGACCAGGCCCTGCTTACCTCTGTTTTGGTTTTT
GTTTTTGATATTTTTTTTCCATTGTGTTTTTACGTAGTGTCATGTTCTGTGCATATAGTGTTGTATTCT
CCTTTGCACTGTTTATGTTACAGTGAAGGCTCTCCTTATTAAAAATCTTCGCAAAGGTCACTTTTTAATG
GCTATCTAACACTCCATATGTGGTGGGCAAGTCTGGTTGGCCTCCGGGGGGTTTCCAGGTATAGGGGATG
```

Figure 20 (Continued)

TAGGGCCTTGCCTGGCCTGGTCTGCGGGTCCATCGTCAGTGCCTGAGCGGCCAGCAGAAGGGGGGCAGCA
GCCTCCACTGAGCCTCTGGTTCCCATTTCCCAGGTTCTCCAGAGAGCGGGCATCCAGAGAGGAGTCCTGG
GAGAGCGGGCGGAGCGAGCGAGGGCCCCCGGACTGGAGGCTTGAGAGCTCCAACGGGAAGATGGCTTCAC
GGAGGTCAGAAGAGAAGGAGGCCGGCGAGATCTGAACCCGTCTCCCGGGTGCTGTAAATAGTCTGATAAA
CGTTCACACAGTCTAAAATTACCCTTTATATTTGCTGAATACAACTCATCTTTTGTAGTTTAAAATTTCT
ATTGTTTTGGAGCTAGCTGTGAGTTTCTAGAAGTGTACAGAGTTGCTCCTGTGTTCCCGGGTCATGTTGA
GTAGGAATAAATAAATCTGATGCTGCCTCCTGAGGCTGCGGGGGGTTTCTGC

>gi|147899793|ref|NM_018679.4| Homo sapiens t-complex 11 homolog (mouse) (TCP11),
transcript variant 2, mRNA
AGCCTGCCGCTTCCGGCTCTGGCGGGGGGGCACGTGCCCCGTCCCGTTGCCCCGGCGACCGCGGCGGTT
TGTTCTCAGGCCCCGGCCTTTCTCACCGTGCGACGCCCAACCCGCCGCTCCGCCGCGGTGGTACGCTCC
AGGCCGCCAGGCCGCGAGGCCCACCGAGCGGACGCCAGTGGATGACCCGCGGCGGGGGAGGAGGAGATAC
CATCAGCAAAATGCCAGACGTCAAGGAGAGTGTGCCCCCGAAATATCCTGGCGACTCAGAGGGCAGGTCC
TGTAAGCCCGAAACCTCAGGACCCCCCAGGAAGACAAGAGCGGCTCCGAGGACCCCCCTCCCTAGAACG
TAACTAGTCATCAAACTGAGGAGCTGTCCGTGTGCAACAACTCAAGATAAAATTCTTGACTATTGAAATG
CGAAAAATTAGATTGAGGCTTTGCGGCTGAATTAGATTGGTTTTTCTTGTGGCCACATGAGGTCGCTGCT
GGTTAACTGAATGGCACCAAAAGGCATATTGGGGTCATTTCCAACAGCTATGAACCTGAGTCTGGAAGGC
AAGGTCAAGGAGACAGTGCACAATGCCTTTTGGGACCATCTTAAAGAGCAACTATCAGCAACTCCCCCTG
ACTTCAGCTGTGCTCTTGAACTTCTGAAAGAAATTAAAGAGATCTTGCTATCACTGCTATTACCACGCCA
GAACCGCCTGAGAATTGAGATTGAAGAAGCTCTGGACATGGACTTGCTCAAGCAGGAGGCAGAACATGGG
GCCCTGAAAGTCCTCTATCTCTCTAAGTACGTTCTCAACATGATGGCTTTGCTGTGTGCACCAGTTCGAG
ATGAAGCAGTGCAGAAACTAGAAAACATTACGGATCCTGTTTGGCTACTGAGAGGGATCTTCCAGGTTCT
GGGCCGGATGAAAATGGACATGGTGAACTACACTATCCAGAGCCTTCAACCCCACCTGCAGGAACATTCC
ATTCAGTATGAACGGGCTAAATTCCAGGAACTCCTCAATAAGCAGCCTAGTCTCCTTAATCACACCACCA
AATGGCTGACCCAAGCAGCAGGAGACCTCACCATGTCACCTCCGACTTGCCCAGACACTTCTGACTCCTC
CAGTGTGGCTGGCCCCTCTCCCAATGAGGCAGCCAACAACCCAGAGCCCCTCAGCCCCACAATGGTGCTG
TGTCAGGGCTTCTTGAACCTCCTTCTCTGGGACCTTGAAAATGAAGAGTTCCCTGAGACCCTGCTGATGG
ACAGAACCCGGCTGCAGGAGCTGAAGTCCCAGTTGCACCAGTTAACCGTCATGGCCTCAGTCTTGCTGGT
GGCCAGTAGTTTCTCCGGCAGTGTTTTGTTTGGCTCACCCCAATTTGTAGATAAACTGAAACGCATAACC
AAATCCTTGTTGGAAGACTTTCACTCCAGGCCTGAGGAAGCTATACTGACTGTGAGTGAACAGGTATCTC
AGGAAATCCATCAAAGCCTCAAGAATATGGGCCTTGTTGCTCTAAGCAGTGATAATACAGCATCTCTAAT
GGGACAGCTCCAGAACATTGCCAAGAAGGAGAACTGTGTCTGCAGTGTTATTGATCAGCGGATCCATTTG
TTTCTCAAATGCTGTTTGGTTCTTGGTGTGCAGCGGTCTCTATTAGACCTTCCTGGAGGCCTTACTCTCA
TTGAAGCAGAACTGGCAGAACTGGGCCAAAAGTTTGTCAACTTGACACATCACAATCAGCAGGTGTTTGG
TCCCTACTACACTGAGATCCTAAAAACCCTCATTTCCCAGCCCAGGCACTGGAAACAAAAGTGGAGTCT
GTTTGATAGCGTCGGCTCAGAGCCCTGGTACCTTGGACCCAAGAGGAGGCCCATCATCTTCCTGGAGTAA
CATCACCAGTGACCAGCAGACAGTGAGCTTCTATCCCAGGCCCTGCAGCCAGTACACCAAGGCTGTAGGG
ATCAAGCATGTAAACACCAACTGGTCCATACCCATTCATTAATAAACTTCTTAAGTGCAAGAA >gi|27413907|ref|NM_020944.2| Homo sapiens glucosidase, beta (bile acid) 2
(GBA2), mRNA

Figure 20 (Continued)

```
AGACCGGAAAGGGCTCGGGTCATCCCGGCGCCCAGGGTCACCTTCCCACGGGCTGGCACCTGGGCGCGGG
CGCTGCCCCGGAGCCGGCCGGCGGGACCTGGCGCCCAATCCTGGGGGACCCGGTGCCGTGGCCCAGGGGC
CGGGCCGAGGTCCCGGGGGCGGTGCCTTGCGGGCCCGTCCCGGGGCGGTGCCTGGTGGGCTGGCCCCGCG
GCTCCTCCCCTCTCTGCGGGCCCAGTCGCCCTTTGGCCGGGCGAGCTAATCGTCGGCTCAATGACGACGA
GGCCCGACCCTTCCCGTCCAGGACCTACAGAGACAACCGAAGGAGAGCCCAAGGCGGCTTCTTTGCTGTC
GCCGCCCCACTGAAGCAAGAGCTCCCCGGCTCCACTGAAACACCAGCTCATTTAAGCTTTCCCCAACGC
CCGGCCCTCCGGGACGATACCTAACAACGACCGGCGCCCGCATCTGGAATAGGCTGGCGAGATACTTAGT
ATCCGAGGGCTCGGGACTTGGCGCCATCGAGGTCATGGGGACCCAGGATCCAGGGAACATGGGAACCGGC
GTCCCAGCCTCGGAGCAGATAAGCTGTGCCAAAGAGGATCCACAAGTTTATTGCCCTGAAGAGACTGGCG
GCACCAAGGATGTGCAGGTTACAGACTGTAAGAGTCCCGAAGACAGCCGACCCCCAAAAGAGACGGACTG
CTGCAATCCGGAGGACTCTGGGCAGCTGATGGTTTCCTATGAGGGTAAAGCTATGGGCTACCAGGTGCCT
CCCTTTGGCTGGCGCATCTGTCTGGCTCATGAGTTTACAGAGAAGAGGAAACCCTTTCAAGCTAACAACG
TCTCCCTAAGCAACATGATAAAGCATATAGGCATGGGCTTGAGGTACCTGCAGTGGTGGTACCGGAAGAC
CCATGTGGAAAAGAAGCACACCTTTCATCGACATGATCAATTCTGTACCCCTAAGACAGATTTATGGTTGT
CCCTTGGGTGGCATCGGGGAGGCACTATTACCCGTGGCTGGAGAGGCCAGTTCTGTCGTTGGCAGCTTA
ACCCTGGAATGTATCAGCACCGGACAGTCATCGCTGACCAATTCACAGTGTGCCTGCGTCGGGAAGGGCA
GACTGTGTACCAGCAAGTCCTGTCCCTGGAGCGCCCAAGTGTCCTCCGCAGCTGGAACTGGGGCCTGTGT
GGGTACTTTGCTTTCTACCATGCCCTCTATCCCCGAGCCTGGACTGTCTATCAGCTTCCTGGCCAGAATG
TCACCCTCACCTGCCGTCAGATCACACCCATCTTGCCCCATGACTACCAGGACAGCAGCCTGCCTGTAGG
AGTCTTTGTGTGGGATGTGGAAAATGAAGGGGACGAAGCTCTAGATGTGTCCATCATGTTCTCCATGCGG
AATGGACTGGGTGGTGGAGACGATGCCCCAGGGGGTTTGTGGAATGAGCCCTTCTGTCTGGAGCGTAGCG
GGGAAACTGTCCGGGGGCTGCTCCTGCATCATCCAACCCTTCCAAACCCCTACACGATGGCTGTGGCTGC
ACGAGTCACGGCAGCTACCACGGTAACCCACATCACAGCCTTTGACCCTGACAGCACGGGGCAGCAGGTG
TGGCAGGATCTACTTCAGGATGGACAGCTGGACTCTCCCACTGGCCAAAGCACCCCTACGCAGAAAGGAG
TAGGCATTGCTGGAGCTGTGTGTGTTTCCAGCAAGTTGCGACCTCGAGGCCAGTGCCGCCTGGAGTTTTC
ACTGGCTTGGGACATGCCCAGGATCATGTTTGGAGCTAAAGGCCAAGTCCACTACAGGCGGTATACAAGG
TTCTTTGGCCAGGATGGAGATGCAGCACCTGCCCTCAGCCACTATGCACTGTGCCGATACGCAGAGTGGG
AAGAGAGGATCTCAGCTTGGCAGAGCCCGGTATTGGATGACAGATCACTGCCTGCCTGGTACAAATCTGC
GCTGTTCAATGAACTATACTTCCTGGCTGATGGAGGCACAGTGTGGCTGGAAGTTCTTGAGGACTCCCTA
CCAGAGGAGCTGGGCAGAAACATGTGTCACCTCCGCCCCACCCTACGGGACTACGGTCGATTTGGCTACC
TTGAGGGCCAGGAGTACCGCATGTACAACACATATGATGTCCACTTTTATGCTTCCTTTGCCCTCATCAT
GCTCTGGCCCAAACTTGAGCTCAGCCTACAGTATGACATGGCTCTGGCCACTCTCAGGGAGGACCTGACA
CGGCGACGGTACCTGATGAGTGGGGTGATGGCACCTGTGAAAAGGAGGAACGTCATCCCCCATGATATTG
GGGACCCAGATGATGAACCATGGCTCCGCGTCAATGCATATTTAATCCATGATACTGCTGATTGGAAGGA
CCTGAACCTGAAGTTTGTGCTGCAGGTTTATCGGGACTATTACCTCACGGGTGATCAAAACTTCCTGAAG
GACATGTGGCCTGTGTGTCTAGCTGTGATGGAATCTGAAATGAAGTTTGACAAGGACCATGATGGACTCA
TTGAAAATGGAGGCTATGCAGACCAGACCTATGATGGATGGGTGACCACAGGCCCCAGTGCTTACTGTGG
AGGGCTGTGGCTGGCAGCTGTGGCTGTGATGGTCCAGATGGCTGCTCTGTGTGGGCACAGGACATCCAG
GATAAGTTTTCTTCTATCCTCAGCCGGGGCCAAGAAGCCTATGAGAGACTGCTGTGGAATGGCCGCTATT
ACAACTATGACAGCAGCTCTCGGCCTCAGTCTCGTAGTGTTATGTCTGACCAGTGTGCTGGACAGTGGTT
CCTGAAGGCCTGTGGCCTAGGAGAAGGAGACACTGAGGTGTTTCCTACCCAACATGTGGTCCGTGCTCTC
CAAACTATCTTTGAGCTGAACGTCCAGGCCTTTGCAGGAGGGCCATGGGGCTGTGAATGGGATGCAGC
```

Figure 20 (Continued)

CCCATGGTGTCCCTGATAAATCCAGTGTGCAGTCTGATGAAGTCTGGGTGGGTGTGGTCTACGGGCTGGC
AGCTACCATGATCCAAGAGGGCCTGACTTGGGAGGGCTTCCAGACAGCTGAAGGCTGCTACCGTACCGTG
TGGGAGCGCCTGGGTCTGGCCTTCCAGACCCCAGAGGCATACTGCCAGCAGCGAGTGTTCCGCTCACTGG
CCTACATGCGGCCACTGAGCATATGGGCCATGCAGCTAGCCCTGCAACAGCAGCAGCACAAAAAGGCCTC
CTGGCCAAAAGTCAAACAGGGCACAGGACTAAGGACAGGGCCTATGTTTGGACCAAAGGAAGCCATGGCA
AACCTGAGCCCAGAGTGAGCCGTCTGAACTGTGGGAGGGAAGTGCTAACAGCCCAGCCTCCAGCCTGGCC
TTTCCTCCTTCCCCTCTGAACCTCCTGCAACCCTGAGCCATCAGGACAATCATACCCCTTCCCTTCTCTC
CACCCAATTGTGCCAGTAAATGGGGGTTGAGGGTGACCTAGGCAGCATTAGAATCACTTATTTATTTCTT
TCCTCACCTGTTCCCTGACTGCGTGAAATGTTCAGGGAGGTCAGTTGATTTCCCCAGGTACATTCATGGT
GTGACAGACACATGGGTACAAATAAAAGACCCAGAAAGCCAAAAAAAAAAAAAAAAAAAAAAAAAAAAA

>gi|217330654|ref|NM_021972.3| Homo sapiens sphingosine kinase 1 (SPHK1),
transcript variant 1, mRNA
AGTGCCCTCCCCGCTCCGCGGCGCCGGCTGCGAAGTTGAGCGAAAAGTTTGAGGCCGGAGGGAGCGAGGC
CGGGGAGTCCGCTCCAGCGGGGCGCTCCAGTCCCTCAGACGTGGGCTGAGCTTGGGACGAGCTGCGTTCC
GCCCCAGGCCACTGTAGGGAACGGCGGTGGCGCCTCCCCAGCAAACCGGACCGACTGGGTCCAGCCGCCG
CAGGGAATGACGCCGGTGCTCCTGCAGCCACGGCTCCGGGCGGGGAAGGCGAGCCCCACAGCCGGCCCTG
CGACGCCCGCCTGGGCAGCACCGATAAGGAGCTGAAGGCAGGAGCCGCCGCCACGGGCAGCGCCCCCACA
GCGCCAGGGACCCCCTGGCAGCGGGAGCCGCGGGTCGAGGTTATGGATCCAGTGGTCGGTTGCGGACGTG
GCCTCTTTGGTTTTGTTTTCTCAGCGGGCGGCCCCGGGGCGTGCTCCCGCGGCCCTGCCGCGTGCTGGT
GCTGCTGAACCCGCGCGGCGGCAAGGGCAAGGCCTTGCAGCTCTTCCGGAGTCACGTGCAGCCCCTTTTG
GCTGAGGCTGAAATCTCCTTCACGCTGATGCTCACTGAGCGGCGGAACCACGCGCGGGAGCTGGTGCGGT
CGGAGGAGCTGGGCCGCTGGGACGCTCTGGTGGTCATGTCTGGAGACGGGCTGATGCACGAGGTGGTGAA
CGGGCTCATGGAGCGGCCTGACTGGGAGACCGCCATCCAGAAGCCCCTGTGTAGCCTCCCAGCAGGCTCT
GGCAACGCGCTGGCAGCTTCCTTGAACCATTATGCTGGCTATGAGCAGGTCACCAATGAAGACCTCCTGA
CCAACTGCACGCTATTGCTGTGCCGCCGGCTGCTGTCACCCATGAACCTGCTGTCTCTGCACACGGCTTC
GGGGCTGCGCCTCTTCTCTGTGCTCAGCCTGGCCTGGGGCTTCATTGCTGATGTGGACCTAGAGAGTGAG
AAGTATCGGCGTCTGGGGGAGATGCGCTTCACTCTGGGCACCTTCCTGCGTCTGGCAGCCCTGCGCACCT
ACCGCGGCCGACTGGCCTACCTCCCTGTAGGAAGAGTGGGTTCCAAGACACCTGCCTCCCCCGTTGTGGT
CCAGCAGGGCCCGGTAGATGCACACCTTGTGCCACTGGAGGAGCCAGTGCCCTCTCACTGGACAGTGGTG
CCCGACGAGGACTTTGTGCTAGTCCTGGCACTGCTGCACTCGCACCTGGGCAGTGAGATGTTTGCTGCAC
CCATGGGCCGCTGTGCAGCTGGCGTCATGCATCTGTTCTACGTGCGGGCGGGAGTGTCTCGTGCCATGCT
GCTGCGCCTCTTCCTGGCCATGGAGAAGGGCAGGCATATGGAGTATGAATGCCCCTACTTGGTATATGTG
CCCGTGGTCGCCTTCCGCTTGGAGCCCAAGGATGGGAAAGGTGTGTTTGCAGTGGATGGGGAATTGATGG
TTAGCGAGGCCGTGCAGGGCCAGGTGCACCCAAACTACTTCTGGATGGTCAGCGGTTGCGTGGAGCCCCC
GCCCAGCTGGAAGCCCCAGCAGATGCCACCGCCAGAAGAGCCCTTATGACCCCTGGGCCGCGCTGTGCCT
TAGTGTCTACTTGCAGGACCCTTCCTCCTTCCCTAGGGCTGCAGGGCCTGTCCACAGCTCCTGTGGGGGT
GGAGGAGACTCCTCTGGAGAAGGGTGAGAAGGTGGAGGCTATGCTTTGGGGGACAGGCCAGAATGAAGT
CCTGGGTCAGGAGCCCAGCTGGCTGGGCCCAGCTGCCTATGTAAGGCCTTCTAGTTTGTTCTGAGACCCC
CACCCCACGAACCAAATCCAAATAAAGTGACATTCCCAGCCTGAAAAAAAAAAAAAAAAAA

Figure 20 (Continued)

>gi|38570141|ref|NM_022474.2| Homo sapiens membrane protein, palmitoylated 5
(MAGUK p55 subfamily member 5) (MPP5), mRNA
GGGGCCGGTCTCGCGCGGTCTAGAAGTGGAGTTGCTGGCGGCTGCGGCGGTGACGGCGGCGACGGAGGAG
GCAGGCGGTGGGGCGGGGCGGGGACTAAGGATTCTGAGGTGGGGAGTCGGGAGTTTCTGGATTCTTTAT
CCGGAATTTCAAGGGCCGCCGGAGGGCTGTCGCTTCTGCAGTGCGTAGGAGCGGCCGGGGCGGGAGGCTC
CGCGGAGCCGAGGCGTGGAGAATAAGAAAGCCTTGAGTTTTGTGAAAAACCGGAGAAGAGAAACTAAAAG
GACAGTAGAAAAGGCTTTTCCAGTTTGCATAATATTTCCTTCATGGATACTTTTTCATAGCATTATTATG
TGATGTGAGAAGTTTTTTTTTTGAAGTAACATGGATTTTATACTACAGAATCAAGAGAATTGGCTTATA
GGAAAAATTGATTTATAAAAAGTGGTACAGGTTTTCATAGATAACCATGACAACATCCCATATGAATGGG
CATGTTACAGAGGAATCAGACAGCGAAGTAAAAAATGTTGATCTTGCATCACCAGAGGAACATCAGAAGC
ACCGAGAGATGGCTGTTGACTGCCCTGGAGATTGGGCACCAGGATGATGCCAATACGTCGAAGTGCACA
GTTGGAGCGTATTCGGCAACAACAGGAGGACATGAGGCGTAGGAGAGAGGAAGAAGGGAAAAAGCAAGAA
CTTGACCTTAATTCTTCCATGAGACTTAAGAAACTAGCCCAAATTCCTCCAAAGACCGGAATAGATAACC
CTATGTTTGATACAGAGGAAGGAATTGTCTTAGAAAGTCCTCATTATGCTGTGAAAATATTAGAAATAGA
AGACTTGTTTTCTTCACTTAAACATATCCAACATACTTTGGTAGATTCTCAGAGCCAGGAGGATATTTCA
CTGCTTTTACAACTTGTTCAAAATAAGGATTTCCAGAATGCATTTAAGATACACAATGCCATCACAGTAC
ACATGAACAAGGCCAGTCCTCCATTTCCTCTTATCTCCAACGCACAAGATCTTGCTCAAGAGGTACAAAC
TGTTTTGAAGCCAGTTCATCATAAGGAAGGACAAGAACTAACTGCTTTGCTGAATACTCCACATATTCAG
GCACTTTTACTGGCCCACGATAAGGTTGCTGAGCAGGAAATGCAGCTAGAGCCCATTACAGATGAGAGAG
TTTATGAAAGTATTGGCCAGTATGGAGGAGAAACTGTAAAAATAGTTCGTATAGAAAAGGCTCGTGATAT
TCCGTTGGGTGCTACAGTTCGTAATGAAATGGACTCTGTCATCATTAGCCGGATAGTAAAAGGGGGTGCT
GCAGAGAAAAGTGGTCTGTTGCATGAAGGAGATGAAGTTCTAGAGATTAATGGCATTGAAATTCGGGGGA
AAGATGTCAATGAGGTTTTTGACTTGTTGTCTGATATGCATGGTACTTTGACTTTTGTCCTGATTCCCAG
TCAACAGATCAAGCCGCCTCCTGCCAAGGAAACAGTAATCCATGTAAAAGCTCATTTTGACTATGACCCC
TCAGATGACCCTTATGTTCCATGTCGAGAGTTAGGTCTGTCTTTTCAAAAAGGTGATATACTTCATGTGA
TCAGTCAAGAAGATCCAAACTGGTGGCAGGCCTACAGGGAAGGGACGAAGATAATCAACCTCTAGCCGG
GCTTGTTCCAGGGAAAAGCTTTCAGCAGCAAAGGGAAGCCATGAAACAAACCATAGAAGAAGATAAGGAG
CCAGAAAAATCAGGAAAACTGTGGTGTGCAAAGAAGAATAAAAAGAAGAGGAAAAAGGTTTTATATAATG
CCAATAAAAATGATGATTATGACAACGAGGAGATCTTAACCTATGAGGAAATGTCACTTTATCATCAGCC
AGCAAATAGGAAGAGACCTATCATCTTGATTGGTCCACAGAACTGTGGCCAGAATGAATTGCGTCAGAGG
CTCATGAACAAAGAAAAGGACCGCTTTGCATCTGCAGTTCCTCATACAACCCGGAGTAGGCGAGACCAAG
AAGTAGCCGGTAGAGATTACCACTTTGTTTCGCGGCAAGCATTCGAGGCAGACATAGCAGCTGGAAAGTT
CATTGAGCATGGTGAATTTGAGAAGAATTTGTATGGAACTAGCATAGATTCTGTACGGCAAGTGATCAAC
TCTGGCAAAATATGTCTTTTAAGTCTTCGTACACAGTCATTGAAGACTCTCCGGAATTCAGATTTGAAAC
CATATATTATCTTCATTGCACCCCCTTCACAAGAAAGACTTCGGGCATTATTGGCCAAAGAAGGCAAGAA
TCCAAAGCCTGAAGAGTTGAGAGAAATCATTGAAGACAAGAGAGATGGAGCAGAACAATGGCCACTAC
TTTGATACGGCAATTGTGAATTCCGATCTTGATAAAGCCTATCAGGAATTGCTTAGGTTAATTAACAAAC
TTGATACTGAACCTCAGTGGGTACCATCCACTTGGCTGAGGTGAAAGAAACATCCATTCTGTGGCATGTT
GGACTTGATCTGGCAAAAACTGCCAATAGGAGGACTGCCCGACACTGCAGCAAGATTGAGGATAAGATGG
AAGGCAGCAGTATAAGCTGTAGATCTGTTCTTAGATCTCTTGAATTAGTGAGACGACAGTTCCCTTAGGC
AGTTTGTGCATGGCATCCTTTATTCTCTATACATGGCTTTAGCGGTTCTTGCCTCATTTTGGGATTCTAA
ATGGAAGCTTTCAACAGAGCATTCCATTTTGTCCTGTTAAAACCTTTTGTTTTCACCTAAACCCTTTCTG

Figure 20 (Continued)

```
CTTAGTTGTATCTCTGTGAAAAACTTGTATACACAAGCGTCCATGTCTCACACAAATATTGATGTGATTA
TTCTTAAGTGTTAAATCATTAACACTTAAATGACTTCATTGGGAATATTGAGCAGAGGGACTGTGCTTCT
ATGCACTGGGCAAGGCAGTATTTGCTTAGGAAACTAATTTAGTCATCAGAGATACTTTCCTAAAAAGGAA
AAATAAAAAACAAAATGGTGCCACTTTGGGTTGAAGCTACTTTGTTAGGCTTGAATTCATTTATATGTCT
TTTGATTCTTAAAAAAACAAAAAACATTCCATTAGAAGCACCAGTTTTTTTGCTCAGACTTTGTGGATCA
GACTCTACACTCAACACACTCTAATCTACTTAAAGGTATACAAAATATGCTGATCTTTTTTAAATTATGA
TTTCCTGAATTTTTTTCTTAAGTCGTCTCAACTGATTTACTCACTTAGCTTCCCTTCCCTCATCAGCATA
GTATAATAGAATGTATGTTACATTTTTATGAATGGCAGGTGTTCATTATAATCTGTATTGACTTAAAAAG
TTTCTTCCTCATGATGCTAATAGTTTTTTGTATACATGGGAGGATAGCACATTTGACAGTTTTTGCATTT
TTATGTATGAGCACAGTATCCTATGACTGTGCTACGTATATATAGGTAATAAACTGGAATTCTGTTGATG
AATATAGCTGCTGTACTGTATATTAATATTTAATAGATCAACAAATGGTCATTGAAAACACTTGTTTAGC
ATTAGAATAAAATTATATATGTCCTTGGGAAATATTATGACAGTTGACTTTAAGATCAAAAGGAAGGGAA
GACCTGAAAGTCATTTGAACATTTTAGGAAAAGAATATTGGAGAGAAAAAGGTATTAAATATATAGAAAT
AGGTTTTTAACCTAACAAGGTCTGCCTCTTATGACGAGAATGCAACAGCTTGGTAAATCATAAAAGAAAC
ATTTAAGCTAATAGGATTTTCGTACTGTCTCTATAGCTGTAGCTTTAAAATTCAACGTATATAATTGGCA
TGGAAACTTAATTTGCAGTCTTTTCAAGCCTTTAGGATAGTGTGATGTGTAACAAACAACCTCAAATGTG
AATGCCTTGATTTTATTTTTATGGTGACTTTAGCTACAGCATTTCCTATACCCAGAGCTAAACACTGGAA
TAATACTGACATCATTTAATTTAACATAAGCAATTATGTTTAAGGAGTAATTTGTGTCATGTACATATTT
GATTGATTTTTTTCTTCTACATAATTTTATTTGAACAAATGTAGACAGTTTATATGTCGCCTTTTTCTG
TTCAAATTTGCATGGCCTATTAAGTTGGCTGGAGAGTGTTTTATGTGGAAATATTTTCAAGATAATGTTC
CTTAGGAAGAAAATAACATTCTTGGGTTGAGGGAAGGAATGCCATACACTACTGTCTCTTCAGATCTGAA
ATACTCCAGTTTAGAGCCAGGAAATTTCACAGGTCACACCGATTTTTAGCATTAAAAACTAAGGAATATA
CTTAGCACTTACTTAATCTTTTCAGTTTTCCAGTTTACGTCTCAGGAATGAAGTGTAGTCTATGGTTGAC
AATGGAGTTTTGTGATCCTGCTTATTGTAACTGACAACTGTTTTCAACTCCAAGAGCTAAACTATTGGCA
GTTCATGTTAAGTTAGAGTGAGGGTGTAGGTAGTGTCAGTGAGTGGCTCTTGTGCCTGCTGTAGACATTA
GGCCTGCACTAGGGCCATGTGCTGTCAAGATTCAGGAACATGGCTTTAACAAGCAGATCTTGTATCAAGG
CAGAGGTGATGCCATGCCATACTTTTAGGAAGTCTGAGATGATAAATATTTCAAGGTCAGTGAAGTCTAT
CAATCATTCTCCCCTTCCTCATCAGCAATGGTAGATAGAAATGTCCTAAACTTTTCTAAATCCTAGTGAT
GAGGATGTGCTGATATTCAACATAGTCCTTAAAGTGAAAACTGAGTTGTTGCTGACCTCCACAAAAGAAT
ATGGAAAAAGCCTTGCTGTACACCTAGTTGTACAGCCACTCTGGCCAATTCCATTTCCTGTCCCTCTGT
GGTTCTGACTGGAGACCCCAGTGTGGGGAGGTCTTACCATTTAATATAGAAATGATATCAATAACTAAT
GCTATGTACTTGGAAAATCCAAATAAGGAAGTTTTAGGTTGGTGCATAACTTTGTTTCTCAAATTTTCGT
TGTCAGAACAAATGGAAGGAGAATATTATTTAGACTAATCCAGATTTGCTTTCTATGAAAATCTAATGTC
TGGATTATCTTCCTTTTCTCATGGCCTAAGAAATAAGGATCAATAAGGAATGATTTGAATGTAATTTTGT
GAATGTGGAAAATATAAAGCAGGGATTTAGCCTTAATAAAGGTAACCTTCTGACATCTGTTGTTAATC
CCCCTTTGTACTCTTTTCCTGTATCTGCACTGTTATTTTGAGATGTCATACTGTACACTGTATTGTAAAA
ATAAAAAGTAAAATTATATTTCAAATTTTAAAAGCCAAAAAAAAAAAAAAAAAAA

>gi|131888644|ref|NM_024099.3| Homo sapiens chromosome 11 open reading frame 48
(C11orf48), mRNA
CAGCATTTTCCGCAAGGAATCCATGGCCGCCTGCACAGCCAGCGGAGCGCCCACGGGAGCTCCCCGCAGC
CGCAAGCTGTTGCCGCGCGGTCTCACTACCCCTTGGCGCAGGCTAGAGCGCCCTATAGCAGAAACCATAG
```

Figure 20 (Continued)

ATAAGCGGCCGGCTAGAGAGGACCTGCTCGAGGAAACGTTTGGAATCCGGAGCGCTTGGATCTCAGAATC
ACCACCATGGCCCTTGTGCCAGGGAGAAGCAAGGAGGATGGGCTTTGGACTAGAAATAGCCCAGGCTCCT
CCCAGCATCCAGAAAGTCCCAGGCTGCCCAACCCTCTCTGGGACAGAGGAAAAATTGGCAAGGTTGAAGG
TCACCAGCACATTCAGGATTTCTCTCAAAAGTCCCATCTGCCGTCTATTGTGGTGGAATCCAGTGAGGTG
AATGAAGAGAGTGGGGATCTCCATTTGCCCCATGAGGAGCTGCTGCTGCTCACTGATGGTGAGGAAGAGG
ATGCTGAGGCCTTCTTCCAAGACCAAAGTGAAGAGCCAGGCTGGGCTTGGAGCCCACAGGACCCTAGAAG
TCCTTTAAGAACATTTAACGCTGGACTCAGCTGGGGGCAGGACCAGGATGAAGAAGATGCTTGTTGGATT
CTTGAGGACACAGCATGTCTGGAAGCCACCAACCACTGTCCCTTCTGGGACTCAACAGGCTCCCGTGTTT
GTAGAAGTGGCTTTGTGGAATATTCCCATCTCCTGCCTCCTAATAGCTTTGAGGGAGCTGAAGAAGAAGC
TGTTCAAACGCCGGCGGGTGTTGAATCGGGAGCGGCGTCTGAGGCACCGGGTGGTCGGGGCTGTGATAGA
CCAAGGGCTGATCACGCGGCACCACCTCAAGAAGCGGGCGTCCAGTGCACGTGCCAACATTACACTGTCA
GGGAAGAAGCGCAGAAAACTCCTCCAGCAGATCCGGCTTGCCCAGAAAGAGAAGACAGCCATGGAAGTGG
AAGCCCCTTCAAAGCCAGCCAGGACTAGTGAACCACAGCTCAAAAGGCAAAAGAAGACAAAAGCCCCCCA
GGATGTAGAAATGAAGGACCTTGAAGATGAGAGCTAAACCTCTTCCACTAGAAGATTCTCAACTGGAGCC
AGCCTTCAGACTCAGTGGTTGTTTCAGAGGACTTTGACAAAAGCAAGGCCCCTTTTCACTCTCCAGATTT
CCTCCTACCTAATGGCCTACTGACCTCCCCTAGAGGATGTCTTTGGGAGGGAAGAAGGTACAGAAGAAA
GATTGGAGAAGGGCCTCTCTAGCAGTCAACTCCATTTGTAATAAAGCCCTAGCACTCTGAAAAAAAAAAA
AAAAAAAAAAAAAAAAAAAAAAAAAA

>gi|189409148|ref|NM_024591.4| Homo sapiens charged multivesicular body protein 6
(CHMP6), mRNA
AGGACCCGAGCTACGGTGGCCGCGGGGCGGCGGTGGCGATTGGACTTGGTGGGTCCCGGGCCAGGGGCGG
GCGCCGCCATGGGTAACCTGTTCGGCCGCAAGAAGCAGAGCCGCGTCACGGAGCAGGACAAGGCCATCCT
GCAACTGAAGCAGCAGCGGGACAAGCTGAGGCAGTACCAGAAGAGGATCGCCCAGCAGCTGGAGCGCGAG
CGCGCCCTGGCCCGGCAGCTGCTGCGGGACGGCAGGAAGGAACGGGCCAAGCTGCTGCTCAAGAAGAAGC
GATACCAGGAGCAGCTCCTGGACAGGACGGAGAACCAGATCAGCAGCCTGGAGGCCATGGTTCAGAGTAT
TGAGTTCACCCAGATCGAAATGAAAGTGATGGAGGGGCTGCAGTTTGGAAATGAGTGTCTGAACAAGATG
CACCAGGTGATGTCCATTGAAGAGGTGGAGAGGATCCTGGACGAGACGCAGGAGGCCGTGGAGTACCAGC
GGCAAATAGACGAGCTCCTGGCAGGAAGCTTCACTCAGGAGGATGAAGACGCCATCCTGGAGGAGCTGAG
CGCAATCACTCAGGAACAAATAGAGCTGCCAGAGGTTCCCTCCGAGCCCCTTCCTGAGAAGATCCCAGAA
AACGTCCCTGTCAAGGCCAGGCCCAGGCAGGCGGAGCTGGTGGCAGCTTCGTAACGTGGCCTCGTCTTGT
GGGACTCACGGGGATGCCCCAGGGACTGTGGCCCACAGAGAGTTTGGGTCACGGCCAGCCCCTGACCGGG
TTCCCTGGAGCCCAGTGCGCACGGTGCTGAGCAGAGCTGCAGCCACGCAGGCGCATTGCAGGAGGACTCC
AGAGCGTCTCCTGGAGACCTTGAGCCTGAACGCACTCAGGCGCCACTGGCCTGCTCTCAGTCCGGATTAA
CTCTCGACCGAGCCCAGCTTCTGCCGGTTGTGGGCTCCCCGGTGGCCGAGGCCCAGGCCCAACGCCTCT
GGTGCTGTTCCCCTGCAGTCCCAGCCCCGCGTGGCTCGCGCTCGTCTGTGAGGAAGACACCTCCAGACCT
TGGGGTCCCCGCGCTTCCTCTTGCTCCTCGCTGCTCCCATTAGCTGGTGCAGGCTTCCGTTAAGGGGTCC
CTCCCTTGGCCTGGCTTCCCGGCGCACCTCAGCTTCCCTGCTGGTGGGGGGATCCCCAGGAGACCAGCAT
GTGCTGAACCTCTCTGTGCCTCTGCCTCCGCACCCTAGACACCCACCTCCAGTTTGAAGGTGGCGGGCCA
GGGGCTTTCTTGCTGAATTGACGACTCCGAGAGCCCTGACTCCCGCCTTGCCACTCACGGCTCTGTCCAC
TAGGGCTCAGCCCTGCTGAGAAAGGACCTCCGATGCTTGGGAGACGCTGCTCCGGCAGGTGCAGCCCCGG
AAGTTTGTCCATGGGGGTCCCCGCGGCTGGGGCTCATGGAACTGCGAGACCCGGGACCCTCCTGCCCTGC Figure 20 (Continued)

GGGTCCCCGAGCCACCAGCAGCCAGGACTGGAGGCTGTGGGGCATGGCGTGACTTCTCGTGCACAGGGCT
GGTTTGGTTATGAGACGATCTCGCTGGGACCGCCCCTGCCCGTGGAAAGCCACAAGGACAAAGGGAGCGG
CCACCTCGACCCCCAGACAGGCCGGCCCGTATTAAAGTTGGCCCTGCACGCCCAAAAAAAAAAAAAAA

>gi|87578391|ref|NM_031845.2| Homo sapiens microtubule-associated protein 2
(MAP2), transcript variant 2, mRNA
GGGATAATGCTCCCGGAGAAGGATTCTGCAGCAGTTCTCAAAGGCTAGACTTGAGTGGTATTGCTGCATA
TGCGCTGATTCTTCAGCTTGTCTCTAACCGAGGAAGCATTGATTGGGAGCTACTCATTCAGAAAATTAAA
AGAAAGAAGCCAGAAAATATTATCAACCCTTTGAGAACACGACACAACGAACTTTATATTTTACCACTTC
CTTGAATAGTTGCAGGAGAAATAACAAGGCATTGAAGAATGGCAGATGAACGGAAAGATGAAGCAAAGGC
ACCTCACTGGACCTCAGCACCGCTAACAGAGGCATCTGCACACTCACATCCACCTGAGATTAAGGATCAA
GGCGGAGCAGGGGAAGGACTTGTCCGAAGCGCCAATGGATTCCCATACAGGGAGGATGAAGAGGGTGCCT
TTGGAGAGCATGGGTCACAGGGCACCTATTCAAATACCAAAGAGAATGGGATCAACGGAGAGCTGACCTC
AGCTGACAGAGAAACAGCAGAGGAGGTGTCTGCAAGGATAGTTCAAGTAGTCACTGCTGAGGCTGTAGCA
GTCCTGAAAGGTGAACAAGAGAAAGAAGCTCAACATAAAGACCAGACTGCAGCTCTGCCTTTAGCAGCTG
AAGAAACAGCTAATCTGCCTCCTTCTCCACCCCATCACCTGCCTCAGAACAGACTGTCACAGTGGAGGA
AGCAGCAGGTGGGGAATCAGCTCTGGCTCCCAGTGTATTTAAACAGGCAAAGGACAAAGTCTCTGACGGA
GTAACCAAGAGCCCAGAAAAGCGCTCTTCTCTCCCAAGACCTTCCTCCATTCTCCCTCCTCGGCGAGGTG
TGTCAGGAGACAGAGATGAGAATTCCTTCTCTCTCAACAGTTCTATCTCTTCTTCAGCACGGCGGACCAC
CAGGTCAGAGCCAATTCGCAGAGCAGGGAAGAGTGGTACCTCAACACCCACTACCCCTGGGTCTACTGCC
ATCACTCCTGGCACCCCACCAAGTTATTCTTCACGCACACCAGGCACTCCTGGAACCCCTAGCTATCCCA
GGACCCCTCACACACCAGGAACCCCCAAGTCTGCCATCTTGGTGCCGAGTGAGAAGAAGGTCGCCATCAT
ACGTACTCCTCCAAAATCTCCTGCGACTCCCAAGCAGCTTCGGCTTATTAACCAACCACTGCCAGACCTG
AAGAATGTCAAATCCAAAATCGGATCAACAGACAACATCAAATACCAGCCTAAAGGGGGGCAGGTACAAA
TTGTTACCAAGAAAATAGACCTAAGCCATGTGACATCCAAATGTGGCTCTCTGAAGAACATCCGCCACAG
GCCAGGTGGCGGACGTGTGAAAATTGAGAGTGTAAAACTAGATTTCAAAGAAAAGGCCCAAGCTAAAGTT
GGTTCTCTTGATAATGCTCATCATGTACCTGGAGGTGGTAATGTCAAGATTGACAGCCAAAAGTTGAACT
TCAGAGAGCATGCTAAAGCCCGTGTGGACCATGGGCTGAGATCATTACACAGTCCCCAGGCAGATCCAG
CGTGGCATCACCCCGACGACTCAGCAATGTCTCCTCGTCTGGAAGCATCAACCTGCTCGAATCTCCTCAG
CTTGCCACTTTGGCTGAGGATGTCACTGCTGCACTCGCTAAGCAGGGCTTGTGAATATTTCTCATTTAGC
ATTGAAATAATAATATTTAGGCATGAGCTCTTGGCAGGAGTGGGCTCTGAGCAGTTGTTATATTCATTCT
TTATAAACCATAAAATAAATAATCTCATCCCAAACTGTAGTAATTGTTACAATTTTCTATTTAAAAAAT
GAATAGTACATGCAGAAATTGACCTGATTTCCATTTGCAACAGGAAGACACTGGCTTTACATGGGTCAA
TTGGACAATTATTTTTGCTCTGCTCTGTTTTGCATGGAGTATTATTATTTTAAAAATTGCATTTTTACCT
TTCATGTGCCTGAAGGCTATCCACTACATTCTGAAGGCCTTGTTAAAATCCAAGCTGCTCATTTCACTAT
TCTGTTTCTGAGTGAGAAGATAAAAACTGCCCATTGTAACTTATTTCAGGTTAAATTAAACCAAGGAGTC
TGATTGCAGGAAGGGAAGAGCATGTAAGAAATAAGTTTTTTTAAAGTGTTATTTTGTATAAATGGGAAGA
AAGATTCAATTAAGTTATTAACATTTGGGACCTGGATAATTATATCAGAGTATGTCAGTCCAATAAATTA
TTTAACTAATTAAAAAATAGTTGCAAAGCATTTGAGCTGTGGTTGAGGAAGTGGTGTAAAAGTGCATCCA
TTAGGAATGATGCACTTTCATTAGGATGGACTCGTGTCTGATTAGAATGTCAGTTGATCAGCTAGATTTG
TGTCCACACTACCAGTTTCACACCCCCTTTCCATCTGTTTGATACAGTATTATAGATATAAATATATATA
TATTTCTCTGTGGCCATTTGTGATACTTCCTCATATACTTGAATATTATACTTCTTTATTCACAGTATCT

Figure 20 (Continued)

```
GTGTCTCCTGCACCCTTTGGTGTTGCAATTTTAGATATGTGAAAGTAGATGTTAGCAGGGTTCTCTCCCT
ATTTAAAAAAAATACATTAAAAAAGACAAAAAATTTTAGCATGAAGTTGCTTTCTGTAACAACTCAAAGC
CGTAACCCTGTTTTAGTGCCAGATACAAGTCTCTCCCGTGATGCTAGACAAAAAATTATTTTTCTTTGCT
TTCACCAACATGGAGTTTGTGGGGGTGGGTCCAGTTATACATGAAAGGGTTTACAGATTGTTGGTTTAAG
ATTATGGATTTATCTCATTTTTAATCACAGGATAGTTTGGGGTTTATTCCTATTATTATTCATGAAACCG
ACTTAAGATTTTTTCTTTATTTTTCTTTTTTTTTCCATTTGCTAAAGTTGAAAGTTGAAACTAACTATAA
TAGTTTGAAACATGTTTTCTCATTTTTCCAAATAGTATCTGTTTATTAAATTCTCTAATAGAAGATGTTT
GTCTTTCTTACCCAAAGTAAAGATCCCCTGATCAGAAAGAAAAAATACAATACTTTGGGAAGCTATAGCT
ATAAAACACTTGAGACACAGATATCTAAATCAGTTTTTTTCCAAGACTCCAACATTGCACTCTGTAAAGT
AACACACTGTGATCTAGTATTATTTATCAGTAGATAATACTGTTCTGACTGTATATACAGTCTAGAACTC
ACAAATCAATTAGTTCCTCTCACAAATCATTCATCTTAGACTTACAAATAAGGAATGAAATAGTCAATGG
CCTGATTAAGGCAAAGAGCTACCAGGCTAGATGGACACTTTTTAAAAATTTTATCTGTTCTTTTTCTTGC
TCAGGGCTGGTAGGTTGGATCTGAACCATTAAAATCAAATGGTCCACTAGGCGTATGATCTCTTTGAGCC
AAATCAGTTCCTGAATATAAAGGAGGAAATGATGAGGATGTACTGAGGCAACGGGGAAGTATAGAAACAT
CCAAGACAAAAGCCAAGGGATGCAAAGGCAGAGACACAGGTGCTTTTTGGTGACCCAGTGGATATGGCAA
CCAGTGTAACTGCCATACAAGAAACCCTAGGAGCAAACCCACACCACTCATTCTCAGCTAAGAGATTTTA
CACAGGCAAACGTGTCTTAAACCATCTATAAATCAGTTATTTTATATGACAGTCAAAACCTTAGAAACCT
TAGGATCATTATATCTATTTTCTGCCTATTAATTGCTGTGAGGTTTGATTTGACCAATCTGGGCAATTTA
TTCATCAGCTTCCCTTGAAGTGCACCAGAAAATAGAAGAAAGGTGTGTGGAGACTTAGGGTATTTTATTA
CATGTTTTCATAGTCTTAAATAGTGATTAAATTTCTCTAGAAAGAAGTTAACAGCTCATTAGAAAAGTTT
TAACCTGTGAAATAAGTATTTTTCTCAACATTCTTTAAAGTTTTTATATAAGTTAACACTAGGTAAACAT
TCTGCATACTAGAAGTCAGTTTATTACAAATACATGTCAAAAATAAAGATTATACAAGGCACCAAACTAC
TAGATTTGGCATTAAAACAAATGTTTATTTCTAATCACAACAAAATTATAATGAATAAATGTTCTTGCTT
TGTATGGAAATACAATTCTTTATTAAAGTTAACAGAAAGGAACTGATCGTTTGTACCAGTAAAAGAGAGA
AACACACAGGTTAAATATCTTCTTGTGGGGTTAAGGGGTAGAACCTATCTTGCCTTCACTCTCAAGATAA
CGACTCAAATTAAGCTTTTTGAGCACCACTCTTGTGGGGACACACATACGCTGATCTAGGAATGAAATCT
TCGTGGTCTCAATTCTAGATCTACTATGCCAGTTTCTCTCTGGCTTTAGCCTTTGAGAACCTGTATAAGA
ATACGTAAGTAATCCAGAGCTGTGAAGAGTTTAAAGGCCAACTTCTCCAGTGAACTCAACCTCTGGGTCA
CTTGCAACCAGAAATTGGATACCTCATAATGATGCAGGAAAGACCCGAGTTCATGATGAGTTTCAAAGGC
CACGTTCATTTAGGAACCAACTCTCTCTGGATTTACCTGCTGAGTTCCAGCAGCGTGATGGGCTGACATC
CCACCTACAAGTATGACACCTGTGTAACACCAGCTAGGTACGGCTGGAGAAGGCTGAAGAGAGAATGCCA
TTAAATGGAAGAATGTACTGATTGTAGTGACCTTCTCCACACACACACACACACACACACACACACACAC
CTACAGTAATACAGCAAGCGTGGAATAATCAGCCAATATATAACATTCCATCAGTATTTTATTAAGGAAA
TAACCTGAATGTGGTTGATTTTGACATAGCTGCAATTACAGTTTTCTTCTATTTTTCAAGCCACAATAAG
GAAAATAAACTACTCATGGTCTAAATACTAGAGATAAAGTAGATTCATGGCTTGGTAAGGAAATTTTAAG
CATTCCTTCAAAGATTGACGTGCTAAAATAAGCATTGATGTTTTGAGTTTTTTTACACCTAGGATTTTTA
GCTTGGGTGTGTAGGTGAAGGCCAAGACTCTCTGCAGGAAAAAGCTTATTTTCAAACTCAGAAAATAAAA
TGTCAATCATAAAAATCTACTTCAACTTTAGCAAAAAGAAAAAAAAATCAACAAAAAGTATACTCTGTAT
GCTGGGATTCCGAGGTTCCAACACACTGTTACAAATCTGTGGGGGGTTTCTTTCTTCTGATAATTCTAGA
GCCTGTTACCATAGAAAGGCATTTCTTCAATGGCTGGTTGTAGTTAGTTCATGTTTTTCAATCAAATTTG
CAAATGTATTTGTTGCTGTATAGTGATTGTTTTGCAAAATAAAATTGCTTGTCACCT
```

Figure 20 (Continued)

>gi|149408142|ref|NM_032883.2| Homo sapiens TOX high mobility group box family member 2 (TOX2), transcript variant 3, mRNA
GATTGAACAGCGCGCGTGGGTTTCCCGCAGCCCTGGCGCAGACGCGTGGGCTCCGTGGCGATGCGGGGTG
TTGCCTGAGGCTCCACTGAAGCTATGGCATAATTTGCAGAATTTGCACTTCATTACTTTTCTGAAATTCA
AACAAATTCTGAAACTGCACGAGTTCTGGCTGAGAGCTGTGGATCTGTGCATTTTGATGGTGACAGTGCC
TACGTGGGGATGAGTGACGGAAACCCAGAGCTCCTGTCAACCAGCCAGACCTACAACGGCCAGAGCGAGA
ACAACGAAGACTATGAGATCCCCCCGATAACACCTCCCAACCTCCCGGAGCCATCCCTCCTGCACCTGGG
GGACCACGAAGCCAGCTACCACTCGCTGTGCCACGGCCTCACCCCCAACGGTCTGCTCCCTGCCTACTCC
TATCAGGCCATGGACCTCCCAGCCATCATGGTGTCCAACATGCTAGCACAGGACAGCCACCTGCTGTCGG
GCCAGCTGCCCACGATCCAGGAGATGGTCCACTCGGAAGTGGCTGCCTATGACTCGGGCCGGCCCGGGCC
CCTGCTGGGTCGCCCGGCAATGCTGGCCAGCCACATGAGTGCCCTCAGCCAGTCCCAGCTCATCTCGCAG
ATGGGCATCCGGAGCAGCATCGCCCACAGCTCCCCATCACCGCCGGGGAGCAAGTCAGCGACCCCCTCTC
CCTCCAGCTCCACTCAGGAAGAGGAGTCGGAAGTGCATTTCAAGATCTCGGGAGAAAAGAGACCTTCAGC
CGACCCAGGAAAAAAGGCCAAGAACCCGAAGAAGAAGAAAAAGAAGGACCCCAATGAGCCGCAGAAGCCT
GTGTCGGCCTACGCACTCTTCTTCAGAGACACTCAGGCCGCCATCAAGGGTCAGAACCCCAGTGCCACTT
TCGGTGACGTGTCCAAAATCGTGGCCTCCATGTGGGACAGCCTGGGAGAGGAACAGAAGCAGGCCTACAA
GAGGAAGACAGAAGCAGCAAAGAAGGAATATCTGAAGGCCCTGGCAGCCTACCGGGCTAGCCTCGTCTCC
AAGAGCTCCCCAGATCAAGGTGAGACCAAGAGCACTCAGGCAAACCCACCAGCCAAAATGCTCCCACCCA
AGCAGCCCATGTATGCCATGCCAGGCCTGGCCTCCTTCCTGACGCCGTCGGACCTGCAGGCCTTCCGCAG
TGGGGCCTCCCCTGCCAGCCTCGCCCGGACGCTGGGCTCCAAGTCTCTGCTGCCAGGCCTCAGTGCGTCC
CCGCCGCCGCCACCCTCCTTCCCGCTCAGCCCCACACTGCACCAGCAGCTGTCACTGCCCCCTCACGCCC
AGGGCGCCCTCCTCAGTCCACCTGTTAGCATGTCCCCAGCCCCCAGCCCCTGTCCTGCCCACCCCCAT
GGCACTCCAGGTGCAGCTGGCGATGAGCCCCTCACCTCCAGGGCCACAGGACTTCCCGCACATCTCTGAG
TTCCCCAGCAGCTCGGGATCCTGCTCACCTGGCCCATCCAACCCCACCAGCAGCGGGGACTGGGACAGCA
GCTACCCCAGTGGGGAGTGTGGCATCAGCACCTGCAGCCTGCTCCCCAGGGACAAATCGCTCTACCTCAC
CTAATCCCGCCTCCCTACCATCCCTGAGGCTCGCTGGAAGGCACTGCTCAGAGCCTGAAGGGCTGACAGC
AGAAAAGAGGCCCTGGCCAGAGGCAGGGTGGCCCATCGGAGAGAGCAGTGACACACCCATTGCCCGGGGG
CTGAGTCTCTTCCTCAACCTCCCACCAGACTCTGCAGAGGCAGCCCACTGCCCACCACCAGCCCAAAGAA
CCTGCAGGAACCTTCCGCCCGCTGACCTGCTTGCTCCAGGGTAACTGTGGACCCTGTCCTCGCCCTGCGC
ACGGTACCCTATGTCTGGACACCCGGCCCCAGCTCCAGCCCCAGCCCAGGTGGGCCGCCCCTGGCGGGGT
CGCTTACCAACGGACACCCACCCCAGATGCATGGGCCAGAGGGCCGGCCCCCGGCATAGATGTGCACATC
GGTTTTCCAGTGTGAACAAAAGATTACGAAACCTAGAAACTGTTGGTTCCGTGTAAGTAGTTGACTACGT
GTTTTAGAACTGTGCTGAAGACATCTGTAAGACTATTTTGTGGGGAAAAAAGTAGTTTCCTTTAAGGTA
AAAAGCATTTTATATGATCCTTAGCACATTTTTAAGTTTTATCTTAAGGGAGACGCGCACAAAAGCGGCT
GCCAAACCGTTTCGTCATCCTCACAGCAAGGACCGGACGCTTGCTAGCCACCCGGAGCACTGCTCTCCT
TTTAATCATGTATTCATCTATTTTAAATTGCCGGCGACGACTTTTGTCTATTTATGAAGAAACCTTGAGA
ACGAAGTTACAGCTTATCCTACCGTGTGTGTGGTTTTGGGGTTTCGTTTGGGTTTGGGTTCTTGACGTCG
TTTGCAGCTGTTTCCTGGCCCTGGCGAGTGTCTGTCTTGGTGCCCAGTGCTTCTCTCAAATCTCTTTATA
ATAAAACTTCTGAAAAGCTGAAAAAAAAAAAAAAAAAA >gi|166158927|ref|NM_033118.3| Homo sapiens myosin light chain kinase 2 (MYLK2), mRNA Figure 20 (Continued)

```
CCTGAGCAGCCGCTGGGAGACAGACGGCAACCAGGTTGCCCCTCTTTGCTCCAGCTAGAAAGACTTGAGT
TAGACAAGCAGCAGCACACGCCTCCCTACCTCATGGCGACAGAAAATGGAGCAGTTGAGCTGGGAATTCA
GAACCCATCAACAGACAAGGCACCTAAAGGTCCCACAGGTGAAAGACCCCTGGCTGCAGGGAAAGACCCT
GGCCCCCAGACCCAAAGAAAGCTCCGGATCCACCCACCCTGAAGAAAGATGCCAAAGCCCCTGCCTCAG
AGAAAGGGGATGGTACCCTGGCCCAACCCTCAACTAGCAGCCAAGGCCCCAAAGGAGAGGGTGACAGGGG
CGGGGGGCCCGCGGAGGGCAGTGCTGGGCCCCGGCAGCCCTGCCCCAGCAGACTGCGACACCTGAGACC
AGCGTCAAGAAGCCCAAGGCTGAGCAGGGAGCCTCAGGCAGCCAGGATCCTGGAAAGCCCAGGGTGGGCA
AGAAGGCAGCAGAGGGCCAAGCAGCAGCCAGGAGGGGCTCACCTGCCTTTCTGCATAGCCCCAGCTGTCC
TGCCATCATCTCCAGTTCTGAGAAGCTGCTGGCCAAGAAGCCCCCAAGCGAGGCATCAGAGCTCACCTTT
GAAGGGGTGCCCATGACCCACAGCCCCACGGATCCCAGGCCAGCCAAGGCAGAAGAAGGAAAGAACATCC
TGGCAGAGAGCCAGAAGGAAGTGGGAGAGAAAACCCCAGGCCAGGCTGGCCAGGCTAAGATGCAAGGGGA
CACCTCGAGGGGATTGAGTTCCAGGCTGTTCCCTCAGAGAAATCCGAGGTGGGCAGGCCCTCTGTCTC
ACAGCCAGGGAGGAGGACTGCTTCCAGATTTTGGATGATTGCCCGCCACCTCCGGCCCCCTTCCCTCACC
GCATGGTGGAGCTGAGGACCGGGAATGTCAGCAGTGAATTCAGTATGAACTCCAAGGAGGCGCTCGGAGG
TGGCAAGTTTGGGGCAGTCTGTACCTGCATGGAGAAAGCCACAGGCCTCAAGCTGGCAGCCAAGGTCATC
AAGAAACAGACTCCCAAAGACAAGGAAATGGTGTTGCTGGAGATTGAGGTCATGAACCAGCTGAACCACC
GCAATCTGATCCAGCTGTATGCAGCCATCGAGACTCCGCATGAGATCGTCCTGTTCATGGAGTACATCGA
GGGCGGAGAGCTCTTCGAGAGGATTGTGGATGAGGACTACCATCTGACCGAGGTGGACACCATGGTGTTT
GTCAGGCAGATCTGTGACGGGATCCTCTTCATGCACAAGATGAGGGTTTTGCACCTGGACCTCAAGCCAG
AGAACATCCTGTGTGTCAACACCACCGGGCATTTGGTGAAGATCATTGACTTTGGCCTGGCACGGAGGTA
TAACCCCAACGAGAAGCTGAAGGTGAACTTTGGGACCCCAGAGTTCCTGTCACCTGAGGTGGTGAATTAT
GACCAAATCTCCGATAAGACAGACATGTGGAGTATGGGGGTGATCACCTACATGCTGCTGAGCGGCCTCT
CCCCCTTCCTGGGAGATGATGACACAGAGACCCTAAACAACGTTCTATCTGGCAACTGGTACTTTGATGA
AGAGACCTTTGAGGCCGTATCAGACGAGGCCAAAGACTTTGTCTCCAACCTCATCGTCAAGGACCAGAGG
GCCCGGATGAACGCTGCCCAGTGTCTCGCCCATCCCTGGCTCAACAACCTGGCGGAGAAAGCCAAACGCT
GTAACCGACGCCTTAAGTCCCAGATCTTGCTTAAGAAATACCTCATGAAGAGGCGCTGGAAGAAAAACTT
CATTGCTGTCAGCGCTGCCAACCGCTTCAAGAAGATCAGCAGCTCGGGGCACTGATGGCTCTGGGGGTC
TGAGCCCTGGGCGCAGCTGAAGCCTGGACGCAGCCACACAGTGGCCGGGGCTGAAGCCACACAGCCCAGA
AGGCCAGAAAAGGCAGCCAGATCCCCAGGGCAGCCTCGTTAGGACAAGGCTGTGCCAGGCTGGGAGGCTC
GGGGCTCCCCACGCCCCATGCAGTGACCGCTTCCCCGATGTGAGCCGCCTCGGAGTGTGGCCTGGATCC
ATCCTGCTAGCACCTCCCCAGACAGGGCTCCAGCCTGTCGGCCACACCCCAGACTCCAGGCCCCGTTGA
AGCCGCTCCCGGTTCCCTCCCCAGCTCCTCGTCTTTGAACTGCCGCCGCCGTGGTGACCCCTGCTTTGCC
CCACTGGGAGAGTCCTTAGCCTGGGCCTCCTCCTAGCTGGAGTGCCATGGCTGGGGGTCTCAGCATGTA
GGGCTTCTGTGGTTGTGGATGGGAGGCTCCTGGTGGGGCAGAAAGGCTGCAACGCTGATTCCTAAGGCCC
AGCTGCCAGGGAAGACAGAGCAGGCTTTGTGAGAGAGGACCTCCATGCCCCGCCACCTCCCCACTCCAG
CAGATAAGGCCGAGCCCACACCATCTGGCCCAGGCTGGCCCCCACCCACCTTCCTTGCGACCACCAACAC
ACAGGAACTCTGTGTGAGAGAGAGGGCGCCCAGCCCAGGCCTGGTGGAGGGGGAGGGAGAAGCCAAGGG
ACACAGGAGACCACCCCCGAGCTTGCCTCAGGGCCAAGCCGGCCCAACCCAACCACTCGGGGCCCCATC
TTGGGGGTCACCCATGGCCTCAGATGATGGGGTCAGCAGGCCCAGGAGAATTAGGAAGGCCATGGGGCAG
CCTCCAGTCTGCTCTCAGCTTGTGCCTTGTAAATAAATGTACAGGTTGGATGTGGCCTCCTTC
```

Figure 20 (Continued)

\>gi|194294512|ref|NM_053006.4| Homo sapiens testis-specific serine kinase 2 (TSSK2), mRNA
TCAATGGTAAGGCAGTGCTGTGGAAATCTGTCTGTGTAACTGGGGTGCTATGCAGGCCTGTCTGGGTGAC
TGTCAGGGACAACTGTCCTACCACACCAAGGACACAGCCCTGGGGGTGCTTTTCTTCATAGCCAAAGAAG
CTGCAGGAAACCCACCCTAGTGGGACAAAGACCAATGCAGGGTCAGTCCCCACAGCCAGGTGATGCAAAC
AGGCTGGACGTGGGCCGCCTCCCCTCCAGCTTGACTTGTGACAGGGAAACCAATGCAGCAGCAGCAGGGC
CACCAGAGTCCTGTCCTGGGGACAGGCTTCCTTCCAGCGGGCGGGGAGTGGGTGCTCCTGCCAGACCAGC
CTGGCTTCCACGGTTCCAGAGACCCTGTTCTCCCTCAGCCCAGTCCCGCCCCCACTCCTTGGCTTTATG
AGTTCATTGGCTGAAGTCACCCGGAGACAATGCTGAGTGTTCCACCCCTGAGTCGAAGCCCAGCCCAGGG
CAGCCCAGCCAGACGCCTCCGGTAGTGTAAATGAGGACAATGCCTGCTGGCCCACATGACGGGGGATGT
AGACGGCAGCGGCGCCAGTCGCTCCTGGCACCATGGACGATGCCACAGTCCTAAGGAAGAAGGGTTACAT
CGTAGGCATCAATCTTGGCAAGGGTTCCTACGCAAAAGTCAAATCTGCCTACTCTGAGCGCCTCAAGTTC
AATGTGGCTGTCAAGATCATCGACCGCAAGAAAACACCTACTGACTTTGTGGAGAGATTCCTTCCTCGGG
AGATGGACATCCTGGCAACTGTCAACCACGGCTCCATCATCAAGACTTACGAGATCTTTGAGACCTCTGA
CGGACGGATCTACATCATCATGGAGCTTGGCGTCCAGGGCGACCTCCTCGAGTTCATCAAGTGCCAGGGA
GCCCTGCATGAGGACGTGGCACGCAAGATGTTCCGACAGCTCTCCTCCGCCGTCAAGTACTGCCACGACC
TGGACATCGTCCACCGGGACCTCAAGTGCGAGAACCTTCTCCTGACAAGGACTTCAACATCAAGCTGTC
TGACTTTGGCTTCTCCAAGCGCTGCCTGCGGGACAGCAATGGGCGCATCATCCTCAGCAAGACCTTCTGC
GGGTCGGCAGCATATGCAGCCCCGAGGTGCTGCAGAGCATCCCCTACCAGCCCAAGGTGTATGACATCT
GGAGCCTGGGCGTGATCCTGTACATCATGGTCTGCGGCTCCATGCCCTATGACGACTCCGACATCAGGAA
GATGCTGCGTATCCAGAAGGAGCACCGTGTGGACTTCCCGCGCTCCAAGAACCTGACCTGCGAGTGCAAG
GACCTCATCTACCGCATGCTGCAGCCCGACGTCAGCCAGCGGCTCCACATCGATGAGATCCTCAGCCACT
CGTGGCTGCAGCCCCCAAGCCCAAAGCCACGTCTTCTGCCTCCTTCAAGAGGGAGGGGGAGGGCAAGTA
CCGCGCTGAGTGCAAACTGGACACCAAGACAGGCTTGAGGCCCGACCACCGGCCCGACCACAAGCTTGGA
GCCAAAACCCAGCACCGGCTGCTGGTGGTGCCCGAGAACGAGAACAGGATGGAGGACAGGCTGGCCGAGA
CCTCCAGGGCCAAAGACCATCACATCTCCGGAGCTGAGGTGGGGAAAGCAAGCACCTAGCATGACAATGG
CCCCGTTGTGTGTGGTGGGGTCGGGGTTGGGGGGCATGGTGCAGTCGGCCTTCACGTAAACTAAGTAGG
CAGGTAGGATCTGAAGAAGGCACAGGTGCAAGTAAAATTCGTCAATTAAACCACTATTTTGATTACAAAA
AAAAAAAAAAAA \>gi|40018625|ref|NM_130807.2| Homo sapiens MOB kinase activator 3A (MOB3A), mRNA
AGTTGGGTACCGGGAGGGCGAAGGCGGGCGGCAGAGGCGATCAGAAGTTTCCAAGGGTCACTTGTGTCT
CGTCCGTGGGAAGACCGGGGGAGCCCAGAAGGCCTTGGTGTGGAATTCTGAGAGCTGATTCCTGCCTTGT
CTTCTCCACTGTTCCTGGAGGAATCCGAGAAGAGCAGAGCGGAGGGAGCCCAGACACGGTCCGCGGGAG
AGCTGTGGGGCTTGGTGAGTGTTTCGTGGCCTCTCGGGTTGGTCAGCACCCCCAGCCAGCTGGCCCAGGA
CCCCTCTACAGAAGTCCAGGAGAGCAGGCGTCACCAAGATGTCCAACCCCTTCCTGAAGCAAGTCTTCAA
CAAGGACAAGACATTCCGCCCCAAGCGCAAGTTTGAGCCAGGCACCCAGCGCTTCGAGCTGCACAAGAAG
GCGCAGGCGTCGCTGAACGCCGGGCTGGACCTGCGGCTGGCCGTGCAGTTGCCCCGGGCGAGGACCTGA
ACGACTGGGTGGCTGTTCACGTGGTGGACTTCTTTAACCGCGTCAACCTCATCTACGGCACCATCAGCGA
CGGCTGCACGGAGCAGTCCTGCCCCGTCATGTCGGGGGCCCCAAGTATGAGTACCGCTGGCAGGATGAG
CATAAGTTCCGGAAGCCCACGGCACTCTCCGCGCCCAGGTACATGGACCTGCTGATGGACTGGATCGAGG
CGCAGATCAACAACGAGGACCTCTTCCCCACCAACGTTGGCACTCCGTTTCCCAAGAACTTCCTGCAGAC

Figure 20 (Continued)

```
GGTGCGGAAGATCCTGTCGCGGCTGTTCCGCGTGTTCGTGCACGTCTACATCCACCACTTTGACCGCATC
GCGCAGATGGGCTCCGAGGCCCACGTGAACACCTGCTACAAGCACTTCTACTATTTCGTCAAGGAGTTCG
GCCTCATCGACACCAAGGAGCTGGAGCCACTGAAAGAAATGACCGCCCGGATGTGCCACTGAGAGCCCCG
CGGGTCTCCCGGTGCCCGAACCGCCGCTGGGGCCTCGGAGACTTGGAGGAGGACGCTCTGGAACCATCAT
CCCGCTTCTCTCCGGCCTGAGCATCTCAGGGAGACCAGGGGCCGAGCCGCTGAGCAGGTGTTGGTCCTCA
GGAGCTCCAACCCCGGACGGCAGATGCCTTCCTCAGTCTCGAGCCTCAGTCTCCCGTCTGGGACTAAAAC
GTGAACTCTGTAATTCTATGTGTTACTAGCAACCGGAAAAGCCCACTGTGTTTTTAAACCACTTCCACTT
TCCAGGAGGCTGGATGGCTTCCAGGGTCACTCCTTGCCCTGGGTGGCTCCCAGGCTCCTGGAACTTCTGC
CTCCACCTCGCTGGGGAGCCCCCAGGGCTGCTGTGGCCACAGCCCTGCCTGGGCCTGTCTCTCAAGGGCA
CCCAGCTTGCTCGGCCTCCTACATGTCTCCCGTTGGGGAGGCAAGAGGCTGAGGGGCTTCCGAGCCCCTG
AGAGCGGACATCTCCTCCCGCAGGCCTTTACTCCGCACTCCCCACTGGCAGCCGCTGGTGTCTCTTCACA
CAGAGGCACAACCTGGACCCAGGCAGCCTCTTTCCTCCCTCCCAATCTCTTCCATTTTTCTACAGATTT
TTTTTTTTTTGGTCATACTAGAGACAGGGGTCTCGCTGAACTCCTGGCCTCCAGTGATCCTCCATCCTCG
GCCTCCCAAAGTGCTGGAATCACAGGGGTGAGCCACCGCACCCAGCCCTCTCTCTTCCTCAATGCACTCT
GCTTCTTCCGTTCTTCCGAAACATTCAGCTGACTGTATCCAGGGCTTCCTGGACTCCTGGGACCCCACGT
CCTGCACCCGGCTTCTGACTCATTTCCTAAGGGCCCCTTTGTGTATCATAAAGGGTTTGATTTTTATAG
TCACATTTACAACCATCTTGAGATTTTTATTTTTTTTGAACGGAGTCTCCCACTGTCGCCCAGACTGGAG
TCCAGTGGCACAATCTCGGCTCACTGCATCCTCCACCTCCTGGGTTCAAGTGATTCTCCTGCTTCAGCCT
CCCAAGTAGCTGGGATTACAGGTGTGCGCCACCACGCCCAGGAAATTATTGTAGTTTTAGTAGAGACAAG
ATTTCACCATGTTGGCCAGGCTGGTCTCAAACTCCTGACTTCAGGTGATCCGCCTACCTTGGCCTCCAAA
AGTGCTGGGATTACAGGCATGAGCTACTGCACCCGGCCTAACCAGGCTGGAGTGCAGTGGTGGGATCTCG
GCTCACTGCAAGCTCCGCCTCCCAGATTCACGCCATTCTCCTGCCTCAGCCTCCCCAGCAGCTGGGACTA
CAGGCACCCACCGTCACACCCGGCTAATTTTTTGTATTTTAGTAGAGACAGGGTTTCACCGTGTTAGCC
AGGATGGTCTTGATCTCCTGACCTTGTGATCCACCAGCCTCAGCCTCCCAAAGTGCTGGGATTACAGGCG
TGAGCCACTGTGCCCGGCCAAGAATTTTTTTATCGATAACATAGTGAGCTCTCTGCCTCTTCGGAACGAT
GTCCACTTTGCTTATGATCAACCCAAGCAGGACTCTTCTCTCCCTGGACGCCTCTCCCCTGGTCTGGAAT
CTTCCAGTTCTGCCAGAATTGGCCTTTCCCAGATGCTGCAAACTTCCAGTTGAACCCCTTTTTCTGTGTG
GCCCCTGGGCTGCGAGACCAAAATCCATGAGTTCTGTGTACCCTAGACCTTTGGAAGGTGAGAGCAGGG
CCCTGAGAAAAGGCAGCCACCTCCTCTCCCTGGCTGAACCCCTGCCACCCTACTCCTCACCAGAATTGTC
AGTGGCCTTTCACCACAGTGGTCCTTCCTGCCTGAGCCCTGCACTGTCCCAGACCACACAGAAGTCTGGT
CACCTCTGGGCGCCTGGGATGGTCACCGAAGAGAAGCACGCTGTCCCGTCTCTCCTGGCTTCTGCCAGA
AAATCGAACAAGTGCAATTAACACACTGTTACTGCCGAAGCCTGAAACTCCCAGGACTTGTCCTTGATCC
TTCCAGAAACCACCAGGTCCGGCACTTGGAGCCCCCGGAGAGGGACCTCCCAGCCGAGCCCTCAAAGAA
CTCCATGAAATCAGGAACTGCTTGATGAAATGTATCTCCTTGTACCTGGAAGATGAAGCCCAAACACCCA
CACCTCTGTCTCCCCCAGGGCTCGGGATGTCTCCAGCAGCCCGGCCACGCAGCTTCCCAGGTGGGCTCGG
GGAGGTGGGAGCAGGGACCATCTCTGTCCCCTCCACCCTCACTCCATCCACCTCGGAGACCACCCTCCCC
CAGCCAGATACGGAATAAAACTACAGACGCAGACGTCGGAAAAAAAAAAAAAAAAAA

>gi|224586869|ref|NM_138443.3| Homo sapiens HAUS augmin-like complex, subunit 1
(HAUS1), transcript variant 1, mRNA
GGCGTGTGGGCGGGGCCTAGGGAGTGAGCGGGGCGCATCTCCCGCTAGGAGTTCCTAGTAAAGTGGCGGG
AGCCGCAGCTATGGAGCCGCAGGAGGAGAGAGAAACGCAGGTTGCTGCGTGGTTAAAAAAAATATTTGGA
```

Figure 20 (Continued)

```
GATCATCCTATTCCACAGTATGAGGTGAACCCACGGACCACAGAGATTTTACATCACCTTTCAGAACGCA
ACAGGGTCCGGGACAGGGATGTCTACCTGGTAATAGAGGACTTGAAGCAGAAAGCAAGTGAATACGAGTC
AGAAGCCAAGTATCTTCAAGACCTTCTCATGGAGAGTGTGAATTTTTCCCCCGCCAATCTCTCTAGCACT
GGTTCCAGGTATCTGAATGCTTTGGTTGACAGTGCGGTGGCCCTTGAAACAAAGGATACCTCGCTAGCTA
GTTTTATCCCTGCAGTGAATGATTTGACCTCTGATCTCTTTCGTACCAAATCCAAAAGTGAAGAAATCAA
GATTGAACTGGAAAAACTTGAAAAAAATTTAACTGCAACTTTAGTATTAGAAAAATGTCTACAAGAGGAT
GTCAAGAAAGCAGAGTTGCATCTGTCTACAGAAAGGGCCAAAGTTGATAATCGTCGTCAGAACATGGACT
TTCTAAAAGCAAAGTCAGAGGAATTCAGATTTGGAATCAAGGCTGCAGAGGAGCAACTTTCAGCCAGAGG
CATGGATGCTTCTCTGTCTCATCAGTCCTTAGTAGCACTATCAGAGAAACTGGCAAGATTAAAGCAACAG
ACTATACCTTTGAAGAAAAAATTGGAGTCCTATTTAGACTTAATGCCGAATCCGTCTCTTGCTCAAGTGA
AAATTGAAGAAGCAAAGCGAGAACTAGATAGCATTGAAGCTGAACTTACAAGAAGAGTAGACATGATGGA
ACTGTGACAAAAGCCAAATAAACATCCTTTTCCCTAACAAAGTAAATTGAATAGGACTTTACAGAGTTCT
TTTTCCTCTTGGCATTTCCTAATAACAAAACTTTCTGTGTTCTTAGATTACAGAATATCATAATTGATAG
AATATGGTTTCTTACTGTGTGTTGCATTTTTGTGCCCAAATACATAGTTTTCATATTAAAAAGCCTTTTC
TCTTAAAAAAAAAAAAAAAAAAAAA

>gi|118572578|ref|NM_138468.4| Homo sapiens islet cell autoantigen 1,69kDa-like
(ICA1L), transcript variant 1, mRNA
GCGACCCGAGGAGGCGGAAGAGCGGCGCCGGCGACGTACTGTAAGACGATATTACTTTAATCATCTTCAC
ATCAGTATTTATGGAATAGCCACAGGTGCCTCATCCTTTAGTAGGAGTTAATTATACATTTACTGGCCGA
GTAAACATCTCCGAATGTCACTCCATGGATTCCTTTGGGCAACCCAGACCAGAAGATAATCAGTCAGTAG
TCAGAAGAATGCAAAAGAAATACTGGAAAACTAAACAGGTCTTTATCAAAGCAACAGGAAAAAAAGAGGA
TGAGCACTTGGTGGCGTCTGATGCTGAACTGGATGCTAAACTTGAGGTTTTTCACTCTGTTCAAGAGACA
TGCACTGAACTTCTGAAGATAATCGAGAAATACCAGCTAAGACTCAATGTTATATCAGAGGAAGAAAATG
AGCTAGGGCTCTTTTTAAAATTTCAAGCAGAACGGATGCAACTCAAGCTGGCAAAATGATGGATGCCAC
TGGCAAGGCACTTTGTTCTTCAGCCAAGCAAAGATTGGCCCTGTGTACTCCTCTGTCTCGTCTGAAGCAA
GAAGTAGCAACATTCAGTCAAAGGGCAGTATCTGATACCTTGATGACAATTAATCGGATGGAGCAGGCAC
GCACAGAATACAGAGGAGCTCTACTGTGGATGAAAGATGTATCCCAAGAGCTGGACCCAGACACCTTAAA
GCAAATGGAAAAGTTTAGAAAAGTACAGATGCAAGTGAGAAATAGCAAAGCTTCTTTTGACAAGTTAAAG
ATGGATGTTTGTCAGAAAGTGGATTTACTTGGAGCTAGTCGCTGCAATATGCTATCTCATTCGCTCACTA
CCTACCAGAGAACACTGCTTGGATTCTGGAAGAAAACAGCTCGAATGATGTCCCAAATTCATGAAGCCTG
TATTGGCTTTCATCCGTATGATTTTGTAGCTCTCAAGCAACTACAAGACACGCCAAGCAAGATTAGTGAA
GACAATAAAGATGAACAAATAGGCGGTTTTCTTACTGAACAGCTCAATAAGCTAGTTTTGTCTGATGAGG
AAGCAAGCTTTGAGAGTGAACAAGCAAACAAAGATCACAATGAAAAACATTCTCAAATGAGAGAATTTGG
AGCACCTCAGTTTTCTAACTCTGAAAATGTTGCAAAAGATCTACCTGTAGATTCATTGGAAGGAGAAGAT
TTTGAGAAGGAATTCTCATTTCTGAACAACCTCCTAAGTTCTGGTTCTTCAAGTACTAGTGAATTTACCC
AAGAATGCCAGACTGCCTTTGGGAGCCCCAGTGCCAGTCTCACATCCCAGGAGCCTTCCATGGGGTCTGA
GCCCCTCGCTCATTCTTCTCGATTCCTTCCTTCACAACTCTTTGACCTTGGCTTTCATGTGGCTGGAGCG
TTCAACAACTGGGTCTCCCAAGAGGAATCAGAACTTTGTCTTTCACACACTGATAACCAGCCAGTGCCTT
CACAGAGTCCAAAGAAATTAACAAGATCCCCCAACAATGGCAACCAAGACATGTCAGCCTGGTTCAATCT
GTTTGCAGACTTGGATCCACTTTCAAACCCAGATGCTATTGGACACTCAGATGATGAACTTCTTAATGCT
TGACTGAAGTTATAATGTCACTTCAGTGGCCTTGAGACATCAATTTTGCAACGTATTTCCTTCGTGGAAA
```

Figure 20 (Continued)

```
GGATTTAGATTGTAACCCGCACACAAAAGCACGGTGTTTGTGAATATAACACCTGTCAGCCAACTTTAGA
CAGATGGTAAAGACCACATTTGAATAAGTACACATCTTTCATATCTTGGATTTGCAGCTGTTGGTACTAT
GTGGAAAATATTAGAAACTTCTATGTGGAAAATATTAGAAACTACAGAGTTTGCGATATTTAGATACTGA
AATTTATGTCAAAATAACGGCTAGGAATAATTCTGTCAATATGGAGTTGAGCTTATTTCTTTGGAAACCC
TTTTAAGTTGCCTTGCTGGCTGTGAGAATTTTATATGTGGATAACAAAGATAGATAGATAGCATGTAAAT
TGGGTTGTGGTTTGGGGTCAGTTTTTAAATGAAATAGTAGCGAGGAGGATTTTCTGTTTTGGAAAACACC
ATTAGAACCAGACCAGCTTTGTTTTGGGTTAGAGAGAGTAAGATTTGAGAACTCAGTTTGCTTTAATGAA
ATCACAGAGAAACTTGGTACTTGTTTTTCTTCATTTGGAGGCTAAAATGTAATGTTTTTTCATTCATACA
AATAATGGACACTCCCTAATTCCATTATTAAATCTTGAAGGGGAAGTAGCAGGATAATTAATTTGCTAA
GCCCATCCTCTGCAGAAACAGAAAAATCTATCTTCCCATCTCCTAAAACTCAGAATGCACAGTAATACTT
AAGGCTTGTACAAGTGTCTTCAGACCCACTTTTTCATACACTTGCTATATAGTAGTATGCAGTATTTATA
TTATTCCTGAAAATAAAATGAGGGGAGAATATTCCCTAAGCAACTGGCAATAGTATTCCTGAAATACCTA
GAAATTTCTATCTGAATGAGGGAGACACTTATGAACACCTTATCCTTACATATATTTGCATACTTATCTC
ATATTTTGTGACATAATTATTTAACCCAGAATACTTTCTGGCAGACATACAGAAAGCTCTGTGTGATCAA
TAAGGGAGTGTCTCATTTTTCTACTTCCCTCTTTCTGTGGGTGACATGATCTGAGGTTCTATTTGATTAC
TAAGCAAAATCTGTTACCCCTACAGGGTTTAGAACCTAAGTATTAGAGAGGAAGGCTATTTAATGGAAGT
TAGTGTAAGCTGATAAAAACGTAGCTACCGTACACACACATCAATCACTCAATTTCCTGTCCTTTTAAAT
TGCCCACCCTTTAATTTTGAAGCAATTTCCCAAGTGTGTGTTTGTTTTATATTTGTCATCCAGTCCATTG
CATTTCCATAAGAAGACATTTTGACTGGCTGGGTGCGGTGGCTCACGCTTGTAATCCCAGCACTTTGGGA
GGCTGAGGCAGGCGGATCACGAGGTCAGGAGATGGAGACCATCCTGGCTAACATGGTGAAACCCGTCTC
TACTAAAAATACAAAAAATTAGCCAGGCGTGGTGGCACGTGCCTGTAGTCCCAGCTACTCCGGAGGCTGA
GGCAGGAGAATGGCGTGAACCCGGGAGGCGGAGCTTGCAGTGAGCTGAGATGGCGCCACTGCACTCCAGC
CTAGGCAACAGAGCAAGACTCCGTCTCAAAAAAAAAAAAAAAAAAAAAAAGACATTTTAACTAAGTTATTC
ACAGTAGCTTCCATGTGCTCTTAGTTCTATTCTAAACAGGCTTATTTAGAAAAGGATTGCTTGTAATGTT
TGTCATGGTACATAGAAAACATTGGACCAGAGTAGGTAAAATGCAGTCCATGTCCCATCCATAGCCATCT
ACAATAGTAACTGCCCACAGGCTCTCCAGAAAACTACTACAATGGCCAAGTACAGTATAGGCTGGAAAGA
CCTTATCTGAAGGTCAGAAACATTGACTCAGAAAAAAGGTATGAAGTCTTTCCATAAAATCTTTTCACAA
TATTACTCCTATTTCTTTTAGATTTTAATGAGCCATTACTTATCTCTTCAGAAGACTTAAGTCTTCCTTT
ATACTCAGTGAAATTTCCCAGAATGTAATACTGTCACTGTTCTGCCAAGTTCCAATCACCAAGATCATGA
TTACGAATCCCAATCTGAATTCTATACCCATGGTGACTCTGATGCTCTCAACTTTTGAGTGCCTCAAAAA
ATGCTAAAACTTTGGCTGGGCATGGTGGCTCACGCCTGTAATCCCAGCACTTTGGGAGGCCATGGCGGGT
GGAACATTTGAGGGCATGAGTTCGAGACCAGCCTGGCCAACATGGTGAAACCCTGTCTCTACTAAAAATA
CAAAAATTAGCCAGGTGTGGAGGTACATGCCTGTAATCCCAGCTACTCAGGAGGCTGAGGCAGAAGAATT
GCTTGAACCCAGGCGGCAGAGGTTGCAGTGAGTCGAGATTGCACCACTACACTCCAGCCTGGGCAACAGA
GAGCGACTCTCTCAAAAAAAAAAAAAAAAAAAAAAAAAAAAAGCTAACTTTATGTCTTGAGAGTTTGTACC
ATTTTTCTTTGTAGTGGTCACCTTGCTAATGCATTAGTTCTGAGATATTTATCTCCCTCACATGTGTGCA
AGGAAGTCCCTGTTATCGAATACAGATACTTTAACAAGCAGACAAAGCAGAAACCCAAAGTCCATACTAG
GAACACCCTAAATTTTCCAAAAGCAAAAGTTCTCCCGAAATGGAGACATACAAGGGACTTTTATTATTCT
GTTACTAGTTTCTATAACATTTCTTCTTTCAACAGAGTATATGTTTCCCATTTAACCCAGAGCAACATTA
ACTTCCTTAGCAAGTCCAGTTCTAACTTCCAACAAGTCCAACCACTGTTTTTGAAGAGCATATCAGTAAC
TATATTAAGATGAAGGTAACCACATTCGTATTTTCTCAAGATTAGTTATTTGAAGCTCAGCAGTTTTTGT
GGTCAGAAAGAAATTTTGCTCTATTAAACCAATACTGCTAATATAAAAAACCACCACACTGAAGAAACGA
```

Figure 20 (Continued)

```
GGGAAAGGACGGGATAAGCACAGAACAGAGAATGACTGGTTGCTTTTTGTCTCAATCTAGATAATCCATT
CAATAAGAAGTAAATTAATTATCCTTAACCAATGGTAGGCTGAGAACAACCCTCAAAATAGATATTTTT
ATGTTAAATGGGGAGAAATATCTATACTTTATGTTATACTGGATAAAAATGTGTTTTAAGTCTAAAAAAA
ACCAGACGAGCTAAACTTTGCCTAGTGTGTCTACAACCATTTTTTAGGAGACGCAGGAATACCAGGGCAT
AATAAGATCAGATTGGTGTAATTTTGTATGTTTTTGAAATCCTTCATTAATTGTAGAACCTTGATATGAT
TAGAAACAAACTGTATTTCAACAAACAGGTTTCAGTATTTGCACACTGAAAAGTGTTTTGTATTTTAAC
TATAAATATTTCACGTATCTGTATAGACCATCTAGAAATGTAGAGGTCTTACAGCATTAGAACGAAGGAA
GTTTACATGTGCTCTATCTATTTTTCTGAGCCTCTTTTAATAAAGATTGCAAGAAGGCATAAAACAAGAG
TTTGTTTCCTGAAGTTTTTAGTACAATTATTGTTTTCCTATTCAAAAACTTGGGTTTTACCTCAAGATCA
TAGTATTAGGAAAGTACATTGAGTTGATACGGACATGGGAGAACGAAAATAAAACCAGGGCAATTAATAT
CCTTGTAAGGCCAGGCGCGGTAGCTCACGCCTATATAACAGCACTTTGGGAGGCCAAGGCAGGCAGATCA
CTTGAAGTTGGGAGTTTGAGACCACCCTGGCCAACATGGTGAAACCCCATCTCTATGAAAAATATAAAAA
TTAGCTGGGCATGGTGGCAGATGCCTGTAATCCCAGCTACTTGGGAGGCTGAGGCAGGAGAATCGCTTGA
ACCCGGGAGGTGGAGGTTGCAGTGAGCTGAGATCAGGCCATGCACTCCAGCCTGGGTGACAGAGTGAGAC
TCCGTCTCAAAAGAAAATCCTTGTGAGATGAATTCGTTCTTATTTCATATACAAGGGGACTATGTAAGAT
ATGGGAAATAATATAATGTACGTTATTTATGTAAATACTTTCAGTAACAAAAACTAACAAATATCAAAAA
TCTGAGCCTAGACACAAACAATTAAATATAAGCCATAGTATGTAACCTGACTTATTGAAGGCAGGAATAA
AAAGAAGAGAGCCAGAATTGATTCAGTTATTTTTGTCTTCCATAGTGTTGGCAGGGCCCTGCATTTCTCT
ACCTTGAGCAATGAAGCAGTCCCAGAATTTTGGAATATAGAAATTAGGAAGGAAAAACGAACTTTAAAAT
ATTAATTTAGTAGAACTGAAAGTAATGCATTTCATGCAACAGTAAAGTGCTTAAACATGGCAAAGAAAAC
TAAGGGACAAGATAAGAAAAATGGTTGGTAAAGATGGGTCACATCCAGAAGCCCAACATAAGCTATTTTT
CCATCTTTTTCTGTACCATTTAAAAGACTACTAAAGAGTTCAAAACAAACTGTCCTTGGCATTTAAAGTC
AAAACATGGTTCTTCACTCAGTGGTGTAAATTAACTACTCATTGGCCAAAGAGTAAATACAAAAAGGAGA
TGAAGTTCTGACTGGTGTTGTGGGTGAGATTTTGCAGTGTATGTTTTTACATTTGTAGTGTACGTTTTAA
ACTTCCGGTTTTCTTGCTGCCTCAACATCTCCACAAACAGGCTGTGAGCACCTGGCCCAGTGTGATATGG
GTGGCCCCTGCCACAAGTTTCCCTTGCTACCTTGCCCATGACCTAGTAACATTTAAATGCACCAGTGAAA
TTCTCTTTTTCTTGTGTGCTTCTCCCTGACCCAAAGGCTCCTGCCCATGTCTTAGGCCTCTCCGCTCCCC
ACCTGCTTGGCTGAGCCCCCTCCCATGTGACCCCCTCTCAGCATGCAGTGACTGGTCTCTCTAGGACCTG
TGAGTATATTACAACTTTTTTTCCTGTGTCTCTCCTGTGATATCTCTTGTGGCTAAACCTCACTGACCAT
AACCTAAAAAAACACATACAAAAAACATGAAAGAAAAAGTTGTTTCTTGAGCTGGCCTGGACGAACGGGG
AGCCAGGGGCTCGACCCTGGCTGTTGGAGGCGCAGTGAGGCCTGGTCTCCGGCTGCCAGACCACGCTGAG
CGGAGCGCGCGGCAGGCTCGCCTCAGCGCTGCGGGGAACGCGCGCGCCGCCGTCCGCGGTCGCCCGTAGG
TGCCTGCACGCGTCGGGGTCACGGCCTTTGGCCGACAGGAGCGAGAAGACTCAGGAGCCGCCCCGCGCCT
TCGATCCGGCGCTGCTGGAGTTCCTGGTGTGCCCGCTCTCCAAGAAGCCGCTCAGATATGAAGCATCAAC
AAATGAATTGATTAATGAAGAGTTGAGAATAGCTTATCCAATCATTGATGGGATTCCTAATATTATCATA
TTAGGCAGCTAGGATGACACATCAAAGAAGCAAGAAGTGGAGCAGCGCTAGTTCATAATTTAAAAAAATA
AAACAGCCAACTCTTCTTAGTACCATATACCTTTTAAAACACAGTGGCAAGTAATAAGCGGAAGAGAAGA
ATCTTTCTGTCTCTTTCTACGTTGACTGTTCTTATTCCACTGGTTTATTTAGCAGGACTGTTCCACTCAG
CCTCTGTAGAAGAAAACTTCCCACAGGGCTGCACTTGCACAGCTAGCCTTTGCTTTTACAGCCTGCTCTT
GCCTATTACCATACCGGTGTATGTATTCTTCCACCTTTGGACCTGGATGGTTATTAAACTCTTCATGCAT
AACTGATGCAACTAGAGTCAATATGCTGTATATATTAATGATAGCTCTTGGGCATCTATCTCTGAAAGCT
CAAATGGATGGAATTTAGTTTGTGGGAAAGAGGCTTTGCTTTGAGCATATCAGGCTTAGGACTGTGGACG
```

Figure 20 (Continued)

```
GCTTAAGTTGCAGACGCTTCTTTTATTGTACTCTTGTTCTGCCCGTGTTTTTTGAAGGCTCTGACATAAC
TGCTTTATCAGAAGAAACATTTTGACAGTGTCTTGTTGGAGATAAACATCCCTAATTGACATGTGATGAC
TACTTCTTATTCCATTCATCTAAGAGTCATTGAAATTTTGTTTTCTTTGTTTGTTTAGCTTCAAGGTCTT
TGGTAGTCACATGTTAGGGATGACTGAAATAATTCCAAAGGAGTGATGTTGGAATAGTCCCTCTAAGGGA
AAGAAATGCATTTGAACGAATGTGATATAAAACCACATAATCAAATAGAAATTTCATGTACTTACAAAAA
TTTAGTTTGTAAAATTACCTTCATTTCTTTGACATTAAATGCTTATATTAGCAATAAAGATGTTGACACT
TTCTCATAAAAATTT

>gi|194306536|ref|NM_144594.2| Homo sapiens gametocyte specific factor 1 (GTSF1),
mRNA
GTTGCTGGGGCTTGCGTGGGAGGAAGGTGACTGTGAGGAAGGTGTGTGTCCACCGAGCACTTGGATTCAG
CTTCTTCATTTCCAACATGGAAGAAACTTACACCGACTCCCTGGACCCTGAGAAGCTATTGCAATGCCCC
TATGACAAAAACCATCAAATCAGGGCTTGCAGGTTTCCTTATCATCTTATCAAGTGCAGAAAGAATCATC
CTGATGTTGCAAGCAAATTGGCTACTTGTCCCTTCAATGCTCGCCACCAGGTTCCTCGAGCTGAAATTAG
TCATCATATCTCAAGCTGTGATGACAGAAGTTGTATTGAGCAAGATGTTGTCAACCAAACCAGGAGCCTT
AGACAAGAGACTCTGGCTGAGAGCACTTGGCAGTGCCCTCCTTGCGATGAAGACTGGGATAAAGATTTGT
GGGAGCAGACCAGCACCCCATTTGTCTGGGGCACAACTCACTACTCTGACAACAACAGCCCTGCGAGCAA
CATAGTTACAGAACATAAGAATAACCTGGCTTCAGGCATGCGAGTTCCCAAATCTCTGCCGTATGTTCTG
CCATGGAAAAACAATGGAAATGCACAGTAACTGAATACCTATCTCATCAAATGCCAGACCCTAGAAGACT
GTTGCTTCTTCTTCTACCAGTGGGTTCTCATTTTCCTCCTAATCTAATTATAGAATGGTAAACTCCCTGT
GACTTTCCAAACTGACAAGCACACTTTTTTCCTCCCCCCTTGAATCCTCATTTAATGCAAGAACCCTCAT
ACTCAGAAGCTTCCAAATAAACCTTTGATACAGATTGCTTAAAAAAAAAAAA >gi|221219032|ref|NM_145173.3| Homo sapiens DIRAS family, GTP-binding RAS-like 1
(DIRAS1), mRNA
GGCTCGGGCGGGCGGGGGCGGCGGCGCCAGCGGACACCGGAGCGGGCAGGAGCAGCGGCCGCGGCGCCG
CAGGGACCAGCGGGCCCAGGCTCGGTCTGGGGTTCTTGCAGCTGGCACCAGCCCTCCCGGCCCCGGCCGC
CCACCCGCCGCGGGGAAGATGCCGGAACAGAGTAACGATTACCGCGTGGTGGTGTTCGGGGCGGCGGCG
TGGGCAAGAGCTCGCTGGTGCTGCGCTTCGTGAAGGGCACGTTCCGCGACACCTACATCCCCACCATCGA
GGACACCTACCGGCAGGTGATCAGCTGCGACAAGAGCGTGTGCACGCTGCAGATCACAGACACCACCGGC
AGCCACCAGTTCCCGGCCATGCAGCGCCTGTCCATCTCCAAGGGCCACGCCTTCATCCTGGTGTTCTCCG
TCACCAGCAAGCAGTCGCTGGAGGAGCTGGGGCCCATCTACAAGCTCATCGTGCAGATCAAGGGCAGCGT
GGAGGACATCCCCGTGATGCTCGTGGGCAACAAGTGCGATGAGACGCAGCGGGAGGTGGACACGCGCGAG
GCGCAGGCGGTGGCCCAGGAGTGGAAGTGCGCTTTCATGGAGACCTCGGCCAAGATGAACTACAACGTCA
AGGAGCTCTTCCAGGAGCTGCTGACGCTGGAGACGCGCCGGAACATGAGCCTCAACATCGACGGCAAGCG
CTCCGGGAAGCAGAAGAGGACAGACCGCGTCAAGGGCAAATGCACCCTCATGTGAGCCCGGAACGCCCGC
CTGCCCGCCGCCCACCCCCACTGACCCCCGCTGCCTCCCCAACACCGACACCCTCCTCGGCCTCCTCCT
CTTCTCTCATCCTTCCTCCGACACCTCGGCTGGGGAAACCGAGGCCACCGCCCCCCCTCCGCTGCCCCT
GCCCACCCCGAGGCAGGGCTGGGGCTTTTCTTCCTCCCCTGCTCTCTCTCCACCCTCCTGTTCTGTCTGT
ACCCTCCAAAACCAAGAGCCGGAGGTGGCCCCCTTGTCCTGCAGATGGGAAAACAGGATGGGAGCTGGC
AAGAGGAGCTGCTTGTTCCCACCAGGACCAGAGGAGGCTGCGTTTCCCCGTTTCCATCTCTTTCCCTGGG
GTGTCCCCAGCCAGACCTGCGCGTCCTGTCCCTCACATTTGATCACTGTGACCTTCTGGGGGAGGGGGA
```

Figure 20 (Continued)

```
GTTGAAAATGCACATCGGCCTCAGATATTTTTTCTTTTTTCTCCTATTTGGTGTTAACATACACCCAAG
CCCACCCGGCCCGTCGTGACCTCTGATCTGTGCCCACTCCTCCGGTTCCAGACGCACCTCTCTCCTCTGT
CTTCACAGTGGGGTGTGGGGCCCGTGGGATGGGCCTCAGGCCACCAGGCAATAACCACAGGGCCTGCAGC
AGTGCCCCTGCCAGCCCCGAATCCCACCCCCGGGACCAGCCACATCCACAGCACAACTGCCCCGCTGGAG
AGGCACCATGGGCGTGGAGGGGCTTCCCGGACACCGCCCACCCGGGACCCGCCTCTTCCACCAAGACAGA
GACGTTAGCAACGCATGGCGGGTGGGGACCTGGGGTGCTCAGGAGGGGGTACCCGGGGCCCCGGCCAGAG
ATACATCAATTACACCCCCGTGGGGGGACAGCCGATGGGAGCCAGCACCAGCAGGATCCGAGGGCGCCCC
GGACAGAGGTCTGCCCCACCCACTTCCTCCCCACCACCTGTGCCCAGAGAGCAGGGCCTGCCCGGGAAG
GTGGCGTCCTGGAGTCGAGTGTACCTGCAGCCATGAGGTTCTGGGTGTTTTTTGAGAGAGTCTGAGTGAC
ACCACACTCGTGTGACCCCACAGGGTTGTGTCCAACATACACGGAAGTGGCTATGGAATGGTGTATTTGT
GCAACCTGGGGTGCGCGGATGGGTGACTTGTATCTAAGTGCATCTGCGTGTATACCTGTGTGTGTCTGTC
TGGGATGATATGTTTTTGTGGCAGTCTGTGTGTGTAATAGTGGTGTAGGGTATACAGAGAGGTGGGTAGT
TGTAGATACCTGTGTGTGGTTGTCAGCAAGACTGGATATGTGTGAGGTGTCTGTGTGAATCTTTGTGCCT
GTATGAGCATGACTATATTTTGGGGAGTGGGTGATATGGTTTATCTGAGAGCATTTATCTGTAAATATGT
TTGTCCTGATTGAGGGACACGATCTGTGTTCCACTCTATAGCAACATGACTCTAGCAATGTGACTTTCGG
TTCCAAATCTGTATCAGTCAGCTACTGCTGTGTAACAAATGACCACAAATGTAGCAACCAGAAACAACAC
ATGCTTATTATCTCATAGATTCTGTGGGTCAAGAGCCTGGGTGCAGGTTGGCTGGGTCCTCTACTTGGGA
TCTCAGGAGGCTGCAATCAAAGCATTCGCCAGGCAGAGGTCTCATCTGAAGGCCTGATCGGGGAAGGATT
TGCTTCTTAGAAGCTCATGTGGTTGTTGCAGCATTCAGTTCCTTGCTGTTGCAAGACTGAAGGCCTCAGT
TCCTCGCTGGCTGTTGGCTGGAAGCTGCCCTTTGTTCTGTACCATGTGGGTCTCTCCACAGCGGGGCTCG
GAGCATGGCAGCTAAGTTAGTGAGGGAAGGTGAGATGGAGGTTTTGGTCTTATTGGGTGTGAGGAAGCAA
CGTGTGTGTGTGCGCACGCCCTTTTGTGCAGTGAGAGAGAGAGAGATTGCACACATGTGTCTCTGTAG
TCATGTGGCCAGGTGGGACTATGTAGGTAACAGATTGCTCGTGTCTGATTTGGTACAAGCATGTTTGTTT
TCCTCTGTGTTCGTGTGAGTGTTTACTCAACAAATGTTTATTGGACACACTCAGAGAGAGGGAGTGTGCA
CACGTGCGTGTGTGTTGCTATCCAGCACGTGGACCGGGCTCCCAGAAGAGCTGGCATTGTGTCTGAGCAG
AGCTGGGTCCCCCCAAAACTTGGGCTGGCCCAGGGCCCACCAGCAGCTGATGTTGCCTCCTCTCCTGTCC
TGGCAGTAGCTTCTGGGTTCTGAAGGTGCCGGAGAGAGTGAGGCTGGGCAGGGGTCTGCGGCCCCTTTCTC
AGGGACACACCCTGATAGCACAATCTCCTTGGGGCCCTGCCCACCTCCAGGCCTCTCCCACCTCAGGCCC
TGCCCGACCCTGGGGAGAGAGGGCATCTGCAATAGGAGGGGACCCGAGCCTGTCCTGGCTGCTGGCCCAT
CCTGCCTGGGCATCCCTGGTGCTGGGGACTGTGCCAGGCCATGCTTGCTGTGACTCCGCCCCTGCCCCCT
CTCCCCCCGCATGTGGGTGCCCCACTCCCCATCGTGGGGTCTGTGTAGCCTTCGCTCTAGACATAGTC
TTCCTGCAATAAAAAAGTGGATCCTGCATTCCCCACCAAAAAAAAAAAAAAAA

>gi|148664245|ref|NM_145865.2| Homo sapiens ankyrin repeat and sterile alpha
motif domain containing 4B (ANKS4B), mRNA
CTGCCTGGAGAGACATCTGGCCAAGTTCTGGTGAGCAGGAAAAATGTCTACTCGTTACCACCAAGCTGCT
AGTGATAGTTACCTGGAACTTCTAAAAGAGGCTACCAAGCGAGATCTAAATCTTTCGGATGAAGACGGCA
TGACTCCTACTCTCTTGGCAGCCTACCATGGGAACTTGGAAGCCCTAGAGATAATCTGCAGTAGAGGAGG
GGACCCTGATAGGTGTGACATCTGGGGAAACACTCCTCTACATTTTGCAGCCTCCAATGGCCATGCCCAC
TGCGTCTCATTCCTGGTCAACTTTGGTGCCAACATCTTTGCCCTGATAATGACTTACAGACTCCACTGG
ATGCTGCTGCCAGCAGGAGCAGAATGAATGTGTTGCTCTCCTGGACAAGGCTGCCACTGCACAGAACAT
CATGAACCCCAAGAAGGTCACCAGGCTGAAGGAGCAGGCTCAGAAGAATGCCAGGAGGCAGATCAAAGAG
```

Figure 20 (Continued)

```
TGTGAGAGGCTCCAGGAGAAGCACCAAAATAAGATGGCCCACACCTACAGCAAGGAGGAATCCGGGACTC
TCTCTTCTTCCAAGGGTACCTTCTCCAGATCATCCCCTTCAAATGCTTCTGCTCCTGGCACATTCGGGTC
ACTATCTAAGGGCATTAAAGACACTTTCAAGATCAAGTTCAAGAAGAACAAAGATACAGCAGAACAGGTG
GGGAAGGAAGGCAGAAGTGGGCAGAGGAACGTGATGGAAGTGTTCAGAGAGGAAGAGGAAGACTCGTTCT
CAGGGGACTTCAAAGAGAAGCTCCAGTTGTCAGCAGAGGAGGACGGCAGTGTGCACCATGAATCCATTCT
CAATCGTCCAGGTCTAGGAAGTATTGTTTTAGAAGGAACAGGATATCGAGTCCTGAAGACATCTCAGAT
AGCAAGAGAGAGTTTGGTTTTAAACTGCCCAGTGAATTGCTTCAAAGACAAGGAGCATCAGAGGCTGATG
AGGGTGCAGCTGATGAAGAGGGAGAGGAAAACGGCCTCAAAGATGATCTGCCGTGGGATGACGATGAAGT
GGAGTGGGAGGAAGATGTGGTCGATGCCACGCCCTGGAAGTGTTCTTGCTGTCTCAGCACCTGGAAGAA
TTCCTGCCTATCTTCAAGAGAGAGCAGATTGATCTAGAAGCTCTGCTGCTCTGCTCTGATGAGGACCTTC
AGAGCATACAAATGCAGCTGGGTCCCAGGAAGAAAGTTCTGAATGCTATCAACAGGAGGAAGCAGGTGCT
TCAACAGCCTGGGCAGCTGGTCGACACCAGCCTGTGATGGAGAGTTTTGGCCTGGAGCATTGGGGTGATG
CTGTGGCCCGCTGGCAGCACTCCAGGCGGCACCCCCTCTTTACCCAATGCCAGACCACTGGGAATGGATT
CTAGGGCATCGGAAATGCCTACCTGAGAGAGAGACCCAAACTTTACTCTGGGAGGTAGGCTATGCCCATC
CAAATAAATCTCCATGAGAAACTTGAGGAGACTTCATAACAAGAATCTGGCATTTCTCTTCAGTTATCTT
ATATGTACATATAATTGTTTTTGTGGTTGTTTTGTTTTGTTTTGTTTTGTTTTTGGAGATGAAGGTCTC
AGTCTCTTACCCAGGCTAGGGTGCAGTGGTATGATCATAGTTCACTGTATTCTCAACCTCCTGGGCTCAA
ATGATCTCCTCCCACCTCAGCCTCCCAAGTAGCTGAGACTACAGGTTCACACCCCCACACCTGGCTTAT
TTTGTATGTTTTAGTAGAGGTGGGGTCTTGCCACATTGCCCAGGCTGGTCTCAAACTCCTGGCCTCAAGC
AATCCTCCCACCTCAGCCTCCTAAAGCACTGGGATTACAGGTGTGAACCACCGTACCCAGCCTATCTTTT
TGATACTTTTGAATAAAGAAAGGGTCATATGCATGACAGGAAAATGAAAGAAACTTCCTTTACTTTTCTA
TCTCTGGATTTAAAATTATAATCTCATCACATTATCCTGCTGCTTGCTTTCCGATCTGTGTAACCTGGGA
ATTCCAATTCTTTTTCTCTCCTGAGATCTATGACTTTGCCTAGTGGTAGAGACTAGAGTTCTTTCCTGGC
CTGCGGCTTGATGCCCAACTTAAATGCATCTAACCCTTTAACAAATGTGTACATGTTTACAAGTAATGGA
AATGCGTCTATAATACTCCTGCCTGAGAATAGAGACAGAGTGGTGGTGGGGAGAGTGAAGAAAGAGATAG
AATACAGGTGGTACCTGTTGTGGACTGAATTGCGTCAAATTCATATGTTGGAGCTCTAACCCCTAATGTG
ACTGTAATTGGAAATAAGACCTTTAAAGAAGTGATTAAGGTTAAATGAAGTCATAAGAATGCAACCCTAA
TCCTGTAGGACTGGTGTCCTTTTTTTCCCTTTTTTTTTTTTTTGAGATGGAGCCTTGCTCTGTCACT
CATGCTGGAGTGCAGTGGCGTGATCTCAGCTCACTGCAACCCCGCCTCCCAGGTTCGAGCACTTTTCAT
GCCTCAGCCTCCTGAGTAGCTGGGATTACAGGCGTGCACCACAACGCCTGGCTAAGTTTTTGTATTTTTA
GTAGAGGCGGGGTTTCACCATGTTGGCCAGGCTGGTCTCAAACTCCTGACCTCAGGTGATCCACCTGCCT
CGGCCTCCCAGAGTGCTGGGATTACAGGCATGAGCCACTGCACCTGGCCTAGGACTGGTGTCCTAAGAAG
AGGAAGAGACACTTAGGTGGAAGGCACACAGAGAGGCCACGTGAGGACACAGTGAGAAGGTGGCCGTCTG
CAAGCCGAGGAGGGGCCTCAGGAGAAACCAACCCTGCAATCACCTTGATCTTGGGCTTTCAGCCCCCAA
AGGTGTGAGAAAATAAACTTCGGTTGATAAACTGCT

>gi|142345724|ref|NM_152376.3| Homo sapiens UBX domain protein 10 (UBXN10), mRNA
GGGAGACCAGGGTTGTTTACCAGCAGGACAGAGCCCGGGCGCAGGCGGCGGATGGAGCGGAACGGCTAGG
GGTCTTGAGAAGCAATGGCCACAGAAGCCCCTGTGAATATAGCACCACCTGAGTGTAGCACTGTTGTCAG
CACAGCAGTTGACAGCCTCATTTGGCAGCCAAACTCACTAAATATGCACATGATAAGGCCCAAGTCCGCC
AAGGGACGGACAAGACCGAGTCTGCAGAAATCCCAGGGCGTGGAGGTGTGCGCTCATCATATACCATCTC
CGCCTCCAGCCATTCCCTATGAGTTGCCAAGCAGCCAAAAACCAGGAGCCTGTGCACCCAAATCTCCAAA
```

Figure 20 (Continued)

```
CCAGGGAGCTTCTGATGAGATCCCTGAGCTGCAGCAGCAAGTACCCACTGGGGCTTCCTCTTCTCTCAAT
AAGTATCCAGTCCTTCCTTCCATCAACAGAAAGAACCTGGAGGAGGAGGCTGTGGAAACCGTTGCCAAAA
AGGCCAGCTCACTGCAACTGAGCAGTATCCGGGCTCTTTACCAAGACGAGACGGGCACCATGAAGACAAG
TGAAGAAGATTCCAGAGCTCGAGCTTGTGCCGTGGAGAGGAAATTCATCGTCCGAACCAAGAAACAGGGC
TCTTCCAGGGCTGGAAATCTGGAGGAACCATCGGACCAAGAACCAAGGTTGCTGCTTGCTGTTAGATCAC
CAACAGGCCAAAGGTTTGTACGCCATTTCCGGCCAACAGATGATTTGCAAACCATTGTTGCTGTGGCCGA
ACAGAAAAACAAAACCTCCTACCGACACTGCAGCATTGAAACAATGGAGGTGCCCAGGAGGCGATTTTCT
GACCTCACCAAATCTCTGCAAGAGTGCAGAATCCCCCACAAGTCTGTGCTGGGCATCTCACTGGAAGATG
GGGAAGGGTGGCCCTGAGTCCACAGCCACCCAGCTGAGGTCCTGGGTCTCTGAGCAAAGGAGCATGCTTG
GGCGTTGTGGCCTCTTAGGCAGCCTGTTTCAAGTGCCATGTGGACCTGGTGCAGCTGGGAAGCTTGGGAC
TCTCGTCTGCACTGCGTGTCCTCTGAAGCAGTGAAGTCTGTGCCTATGCCGAGCGCGCTAAGAAGTCTCC
CTTCCAGCTGTTCCATTCTCTCCACCACCAGCGTAACTGGCAAGTTACCAAGGTTGTTCCTGAAACAGCA
GTGATCATGACTTCTCCTTTCCAGAGTTTTGGGTCCTTCTGAATTAATGGTCCTTTTCGAACACCGGCTT
GCCTTTACAGTGAACTGTGATTCTCTCGAAGCCAATGCTTTCCTGTCTGTATTTGATGCAGGATTAAACA
CTTCCCAGAGAGGATTCTAGTCTGGTAAATAACCACAGTGTAGGAACTATCTAACTGGCATTTGTGTTTC
TTGCGAGTATTTTGAAGAAACAGGCCGTTGACCCCATCTTTGGAAGTAGCCCTTTACCATGCATGGTCAG
TTTCTTAGGGATTTACTATTTGTGTGAGGTGGCATCTAAGGGAAGAATGGGTTTTCTTCCCCAAAACATC
AGCATTTCTAAAATAGTCCTAAAGCTTGAAAGTAAGTTGCTTCCATGAGCATGGATTACCCAGTAGCTAC
TTTTTAATAGAGACTGACTAGGTTTACAACTTCTGGGAGCTACTCTGTGGGCTGAATTCTTCCAAAACCG
AGAAAAGCCAGTGCAGTCTGATTTCTTTTGCTTTTGTCAGTAATGGAATCTTTTGTTTTTAAAATGTACA
AACCTATAAGTTTAAACAGGTTTGTACTGACAACCTCCTTGGCTTATTTGGGGGTGGAGCAATTGTTTTA
TTCCCCAGTTTCAGTGCGTTGCCCACTTCAAACATGGTGTGTCCTTTGGAGCTGTGACAGAGGTGCCTGT
TCTGACTTAGAACCTCTGGAGGAGGAGGGGGGTGCCTTGGTCTCGTGTTACTTTGCTGTGCCTGTGCTGA
GAGACCATGTGCCCGAGCATCTGGTTGACCGGCATGAAGTACATCAGCCTGTCTTAGCCTGAGCTGCTTT
GAAGACCATGGGTCTTGTGTTTCCAACTTCGAAGTGCTGATGTGGACAGTTTGCCAATGTTCTCTTCTA
TTGCAAGTTCAGCCAGACTCCATGACTCATCTGATCCCTTTTATGGCCAAATCATCCTTCAGAGTAGGGA
ACACTCAGACATTCTGTGCATGTTGTTCCCCAAAGCATGGTCATCACAAAGTCCTGAGTTCTGGTGTGT
GCTCCCGCCTCCTGGGTATACAGAGAGAAGGCAGGAATCAGGAGTTCCAGAAGCATATACATGTGGCTAC
CCCAGCAACAAGCGCATCCTGTGCTCAGATAAGCTGCATGGTTGGGAGTGTTTTTTCTCGCACGTTGAGG
CTTAGTGGAGATGGGCACCACTGCCATTTGCTCAGAAGAAGGCTGGTCTGGTCCTAACTGCATCCCACAC
TGCCCAGATCATTCTAGAATAGGTTATTTCTGAATGTTTTATAGAATTTCTTAATACCATCCTGGTTTGG
TCAGCCATTCCTTTGATTGGAAAGGTCAGCTGGGGCCAGTGGTGCCTCAGGCAGGCCCACACAACTGGCC
ACCTCTTCCCGTTAATGACCACAGCAGACAGAATTTGAGCCCAGCACCTAAAAGTACAGGAATTTCACTT
CCCACCAGGACTTGAGCACATAACTCTATGTCTGATCTAGGAGGCTGGGGAAGAGCCTCCCATAAAATC
ACACCTACTCTGTGGTAAGAATAAAATCCCACCCACCTGGGACTTGGTAATTTCTCCAAACAGGAAAGCT
TTAGAAAACTTGAGTGAAATGGAGCAAGCTTGAAGGAGTTAGAATCTTCTGTGCTTAGGGTTTGCTGCTG
CTGGTGAGCTTAGAATTTTGGGGTTGGGAAAAAGTGGAAGGCATAAGCATAGAAATATTTTAGGATATTT
TAGGATATGTGAATAAAGCTAGACTCAAACCAAAAAAAAAAAAAAAA

>gi|209364513|ref|NM_173519.2| Homo sapiens clavesin 1 (CLVS1), mRNA
ACACGCCTCCTACCAAAATCACAGCCCCTTGTGGAGCCCGAGCTCTCATTCACAGCTTTCTAGAGAAATC
TGAGCCCGAACCTGCCAGAATAGGGGATCTCACCCACCCAGTTCAGCAGCGAGGACACCTGCAGAAATAC
```

Figure 20 (Continued)

```
ATTCCCAAAGCAAGGCTGGGCGGCCGTGTGAAGTAAGCAATGGCCTCAGTTTTGCTTCTGTTTTGGATGA
ACACCACCACATAGGGCCTGAATGTGAAAGAAGACCCTCTATTTGTCTGTTCCGGGGCAGCCTGGTAGTA
AAACACTGTTGAATGGGCCACAGTTTCAGCAGACCATCAGGTGAATGGGACCAGTCTCTCTTCTTCCAAA
ATATCAGAAGTTAAACACTTGGAACGGAGATTTGGCCAAGATGACCCATTTACAGGCTGGACTCAGTCCA
GAGACTATAGAGAAAGCTCGCCTGGAACTGAATGAAAACCCCGATGTTTTACATCAGGATATTCAGCAAG
TCAGGGACATGATCATCACCAGGCCTGACATTGGATTTTTACGTACAGATGATGCCTTCATCCTGAGATT
TCTCCGAGCCAGGAAGTTTCACCAAGCGGATGCCTTTAGACTCCTGGCTCAGTATTTCCAGTACCGCCAG
CTAAACCTGGACATGTTCAAAAACTTCAAGGCAGATGATCCCGGCATTAAGAGGGCTCTGATCGATGGGT
TCCCCGGGGTGCTGGAAAACCGAGACCATTACGGCAGGAAGATTCTTTTGCTGTTTGCAGCCAATTGGGA
TCAGAGTAGGAACTCCTTCACAGACATCCTTCGTGCCATCCTGCTGTCATTGGAAGTCCTAATCGAAGAT
CCGGAGCTTCAGATAAATGGCTTCATTTTAATTATAGACTGGAGTAATTTTTCCTTCAAACAAGCCTCCA
AACTGACACCTTCAATCCTTAAACTGGCCATTGAAGGGTTGCAGGACAGCTTTCCTGCCCGCTTTGGAGG
AGTCCACTTTGTCAACCAGCCCTGGTACATTCATGCCCTCTACACACTCATCAAGCCATTTCTTAAAGAC
AAGACCAGGAAACGGATTTTCCTGCATGGAAACAATTTAAACAGCCTTCACCAGCTAATACACCCTGAAT
TTTTGCCCTCTGAATTTGGAGGAACTCTTCCTCCTTATGACATGGGAACTTGGGCCCGACGTTACTCGG
TCCCGACTACAGCGATGAAAATGACTATACTCACACATCCTATAATGCAATGCACGTGAAGCATACGTCC
TCGAATCTGGAGAGAGAATGCTCACCCAAGCTGATGAAAAGATCTCAGTCTGTGGTAGAAGCTGGGACCC
TGAAACATGAGGAGAAGGGAGAGAATGAGAACACCCAGCCACTCCTGGCTCTGGACTGAACCCTGAGTCA
CCCCAATGCTCCTGCACACTGGCCTTCAGTGGTATCAGCCACCCAGGAAGCACATGCACAACTGACCCAT
GCAGACACGTGTGTTCTGCTTGACACAAGGTCCTCCACTCCTGAACCCCTGCAGTGACTGTCACCAGCCA
TCGGTCTGAGCAGCCAAAGTTGGACAAAGACTTGAGAGATGCTTTTTTTTCCCCCAGTGAGGGGACTGG
AGGATGATGCAAGGCATTTATGTAAAAAAGATTCTCCCTCCTTTCATATTTATTGTAGTAAATTGAAAAA
ATAAAGACTAAATTTGATGGACACACTGCATTAGGACAAGAATTTTTCTGAGGTATCACACAGGGACCCT
CTCCAGTTTTTGAAAATTAAGTGCATTTCCAAGTAAATGTATCAGAGTTAAACTGTACAGACACCACTGT
CAAGTTTCATGTAGTACAAAGCCCTGAGACAATAGTATCTCCAGTAATTTCCATTCTTACTGAATTATTT
CCTTTGACCTCATCACCAGCATCGAATTGTTCAGCCTAAGAGCATGTTCTCATAGGTCTGGGTATTTGCA
AAGTTTGCTTATTTTGATGATATCCTGCAAAAAATTATTTTGATGTCACATCTCTTGTCAGGTCACTAGC
TGACTGTCATGAGCTGACGTTAAAGGAAGACACATGGACGTGAAATACGATTATTTCATCTGAGCAATGT
GAGTTACCACAGGCAGCTCAAAAGCCCATTAGTGCAGCATGTGTCTGCAGAGGAGATGTCTCATGAAAAT
CACATGTCAGTGATTAATGAATCCATTCCAGTTGCCTCAACTGGGTCACTACAGCAAAGAAAAGTGCTAT
CAAACCATTTACCCTTGCCCCCACAACCCTCCTGCAACCATTAAAGATGTGGAGAAAGACCATGGTTGTT
GCTGAGAGGGTAAATATTCAATCATGGAGCATGACCCATATGGATGGCTAAATATGCAAGTACTGAAGTA
AGAGAAGACTAGAAATGCAGGATGAAATGTCAAAGGTCATTTTATTTACCTAGTCTCCTTAGAAATGGAG
TCCCCAACTACTCATTCAAAAGAAATCAGACATAAAATAAACAGACATCATATATGATATCCTTACTTGT
GCCATGTTTTCCAAGACCAGTGCATATTTTTAGACATCTCTTATTCGCCCAGCCATCTGCATGACATGGG
TATTTATTAGTATTACCAGTTGGTGCTCAAAGTCAAACAAAAATATTTTAGTTAATAATGGGCAGTAAAA
TATGATTTTACATTATTTTAAATATTTGGGAGAGTTAATTTGTTAGCTAAATAATTCAAGGGAAAGAGAT
TATTCAACTGGTCATAATCACCCCTGATAATATTATTACTAATCTTAATTATTTATTACATCATCTCTTT
CTCAATGGATCTAATGTTTTAATTTTTTCCCCTATTGGTAGAGAACAATAACAGAAGTAATTTTTATATT
ATACACTTGGAGAAATAAAGTTGAAACAGAATTAAAAATATTTCTCAAACAACTGTATCACAATATAAAT
TAAACTAATTCATTTTGTGTAGACATACGAAATCACAAAAATAATAACACTGAAATAATTCTACCAATG
CAGTGATGGAAACACTTTTCTTATGTACCAAGACATAGATAGGTAAGAGAAATAAAGAATTGAAGTGAAT
```

Figure 20 (Continued)

TAGAAAATCCATTTTATTGCTTGGGTTTAAAATAGTTGTGGGATACAAGTATTTACAATGCTATTGGAGT
CAATTATTGACAACACTTTGCAACAGTAATACCATTTCTAGCTTTTCAATTGGCAATACTTAGAACCTTA
CTGTAGTGACCTGATTTTAAATACCATATTATATTTACTAAGTTAAGAGCTAGTTTTTACTCTCTTCCAT
AATTTCATTACATGAATGTAAGATGATGGCTCAAAAATGACGACTTATAGTTTGAATTTATGTGTATGCA
ATATACATATGAGAACCAAATTCAACAAGTGACATGAATGTTACTACATGAACATTGAATTGTATTGCCC
TTGTCAGTTATTTCCTCTGTTCAATAAATACTGAAGGTCACAAACACCTTTTTACTTTTCAAAAAAAAAA
AAAAAA

>gi|313760553|ref|NM_177974.2| Homo sapiens cancer susceptibility candidate 4
(CASC4), transcript variant 2, mRNA
TTTTTTTCCCCGCCTCCCAACCGTGAGGTGTTGGGTTTGGGGGACGCTGGCAGCTGGGTTCTCCCGGTTC
CCTTGGGCAGGTGCAGGGTCGGGTTCAAAGCCTCCGGAACGCGTTTTGGCCTGATTTGAGGAGGGGGGCG
GGGAGGGACCTGCGGCTTGCGGCCCCGCCCCCTTCTCCGGCTCGCAGCCGACCGGTAAGCCCGCCTCCTC
CCTCGGCCGGCCCTGGGGCCGTGTCCGCCGGGCAACTCCAGCCGAGGCCTGGGCTTCTGCCTGCAGGTGT
CTGCGGCGAGGCCCCTAGGGTACAGCCCGATTTGGCCCCATGGTGGGTTTCGGGGCCAACCGGCGGGCTG
GCCGCCTGCCCTCTCTCGTGCTGGTGGTGCTGCTGGTGGTGATCGTCGTCCTCGCCTTCAACTACTGGAG
CATCTCCTCCCGCCACGTCCTGCTTCAGGAGGAGGTGGCCGAGCTGCAGGGCCAGGTCCAGCGCACCGAA
GTGGCCCGCGGGCGGCTGGAAAAGCGCAATTCGGACCTCTTGCTGTTGGTGGACACGCACAAGAAACAGA
TCGACCAGAAGGAGGCCGACTACGGCCGCCTCAGCAGCCGGCTGCAGGCCAGAGAGGGCCTCGGGAAGAG
ATGCGAGGATGACAAGGTTAAACTACAGAACAACATATCGTATCAGATGGCAGACATACATCATTTAAAG
GAGCAACTTGCTGAGCTTCGTCAGGAATTTCTTCGACAAGAAGACCAGCTTCAGGACTATAGGAAGAACA
ATACTTACCTTGTGAAGAGGTTAGAATATGAAAGTTTTCAGTGTGGACAGCAGATGAAGGAATTGAGAGC
ACAGCATGAAGAAAATATTAAAAAGTTAGCAGACCAGTTTTTAGAGGAACAAAAGCAAGAGACCCAAAAG
ATTCAATCAAATGATGGAAAGGAATTGGATATAAACAATCAAGTAGTACCTAAAAATATTCCAAAAGTAG
CTGAGAATGTTGCAGATAAGAATGAAGAACCCTCAAGCAATCATATTCCACATGGGAAAGAACAAATCAA
AAGAGGTGGTGATGCAGGGATGCCTGGAATAGAAGAGAATGACCTAGCAAAAGTTGATGATCTTCCCCCT
GCTTTAAGGAAGCCTCCTATTTCAGTTTCTCAACATGAAAGTCATCAAGCAATCTCCCATCTTCCAACTG
GACAACCTCTCTCCCCAAATATGCCTCCAGATTCACACATAAACCACAATGGAAACCCCGGTACTTCAAA
ACAGAATCCTTCCAGTCCTCTTCAGCGTTTAATTCCAGGCTCAAACTTGGACAGTGAACCCAGAATTCAA
ACAGATATACTAAAGCAGGCTACCAAGGACAGAGTCAGTGATTTCCATAAATTGAAGCAAAATGATGAAG
AACGAGAGCTTCAAATGGATCCTGCAGACTATGGAAAGCAACATTTCAATGATGTCCTTTAAGTCCTAAA
GGAATGCTTCAGAAAACCTAAAGTGCTGTAAAATGAAATCATTCTACTTTGTCCTTTCTGACTTTTGTTG
TAAAGACGAATTGTATCAGTTGTAAAGATACATTGAGATAGAATTAAGGAAAAACTTTAATGAAGGAATG
TACCCATGTACATATGTGAACTTTTTCATATTGTATTATCAAGGTATAGACTTTTTGGTTATGATACAG
TTAAGCCAAAAACAGCTAATCTTTGCATCTAAAGCAAACTAATGTATATTTCACATTTTATTGAGCCGAC
TTATTTCCACAAATAGATAAACAGGACAAAATAGTTGTACAGGTTATATGTGGCATAGCATAACCACAGT
AAGAACAGAACAGATATTCAGCAGAAAACTTTTTATACTCTAATTCTTTTTTTTTTTTTTTGAGACAG
AGTTTTAGTCTTGTTTCCCAGGCTGGAGTGCAATGGCACAATCTTGGCTCACTGCAACCTCCGCCTCCTG
GGTTCAGGCAATTTTCCTGCCTCAGCCTCCCAAGTAGCTGGGATTACAGGCACCCACCACCATGCCCAGC
TAATTTTTGTATTTTTAATAGAGAGCTAATAATTGTATATTTAATAAAGACGGGTTTCACCATGTTGGCC
AGGCTGGTCTTGAACTCCTGACCTCAGGTGATCCTCCTGCATTGGCCTCCCAAAGTGCTGGAATTCCAGG
CATGAGCCACTGCGCCCAGTCTACACACTAATTCTTGTTAGCCCAACAGCTGTTCTGTTCTATCTACCCC Figure 20 (Continued)

```
TCATTTCACGCTCAAGGAGTCATACCTAGAATAGTTACACACAAGAGGGAAACTGGAAGCCAAACACTGT
ACAGTATTGTGTAGAAAGTCACCTCCCTACTCCTTTTATTTTACATGAGTGCTGATGTGTTTTGGCAGAT
GAGCTTTCAGCTGAGGCCTGATGGAAATTGAGATAACCTGCAAAGACATAACAGTATTTATGAGTTATAT
CTTAGTTCTTGAAATTGTGGAATGCATGATTGACAATATATTTTAATTTTTATTTTTTCAAGTAATACC
AGTACTGTTTAACTATAGCCAGAACTGGCTAAAATTTTTATATTTTCAGAGTTGAAGTTGGTGAAGACAT
TCATGATTTAAACACCAGATCCTGAAAGGGGTTAAATCTACTTTGAAATGAATCTGCAATCAGTATTTCA
AAGCTTTTCTGGTAATTTTAGTGATCTTATTTGATTAGACTTTTTCAGAAGTACTAAATAAGGAATTTTA
ACAGGTTTTTATTAATGCACAGATAAATAGAAGTACAGTGAGGTCTATAGCCATTTTATTAAAATAGCTT
AAAAGTTTGTAAAAAAATGAATCTTTGTAATTACTTAATATGTTAGTTAAGAACCCGTCAAGCTTATATT
TGCTAGACTTACAAATTATTTAAATGCATTTATCTTTTTGACACTATTCAGTGGAATGTGTAAGCTAG
CTAATTCTTGTTTTCTGATTTAAAGCACTTTTAAATCTTATCCTGCCCCCTAAAAACAAAAGGTTTTGAT
CACAAGGGGAAATTTAAGATTGTTAACCCTGTTTTTCAGAAGGGCTACTGTTAATTGCACATAAACATGA
AATGTGTTTTCCCCTGTGTACTAACACATTCTAGGCAAAATTCAAACTTATAGTGGTAAAGAAACAGGTT
GTTCACTTGCTGAGGTGCAAAAATTCTTAAGACTTCTGTTTGAAATTGCTCAATGACTAGGAAAAGATGT
AGTAGTTTACTAAAATTGTTTTTCTACCATATCAAATTAAACAATTCATGCCTTTATAGGGTCAGGCCTA
CAATGAATAGGTATGGTGGTTTCACAGAATTTTAAAATAGAGTTAAAGGGAAGTGATGTACATTTCGGGG
GCATTAGGGTAGGGAGATGAATCAAAAAATACCCCTAGTAATGCTTTATATTTTAATACTGCAAAAGCTT
TACAAATGGAAACCATGCAATTACCTGCCTTAGTTCTTTTGTCATAAAAACAATCACTTGGTTGGTTGTA
TTGTAGCTATTACTTATACAGCAACATTTCTTCAATTAGCAGTCTAGACATTTTATAAACAGAAATCTTG
GACCAATTGATAATATTTCTGACTGTATTAATATTTTAGTGCTATAAAATACTATGTGAATCTCTTAAAA
ATCTGACATTTTACAGTCTGTATTAGACATACTGTTTTTATAATGTTTTACTTCTGCCTTAAGATTTAGG
TTTTTTAAATGTATTTTTGCCCTGAATTAAGTGTTAATTTGATGGAAACTCTGCTTTTAAAATCATCATT
TACTGGGTTCTAATAAATTAAAAATTAAACTTGTTTC

>gi|38201611|ref|NM_198204.1| Homo sapiens MAX-like protein X (MLX), transcript
variant 2, mRNA
CGCCACCCGCTTCCTCGCCGCAGGGGGCCCGCCCGCTGGCCCGTTTCCGGTCCGGTGGGTACAAGATGAC
GGAGCCGGGCGCCTCTCCCGAGGACCCTTGGGTCAAGGTGGAGTATGCCTACAGCGACAACAGCCTGGAC
CCCGGGCTTTTTGTAGAAAGCACCCGCAAGGGGAGTGTAGTGTCCAGAGCTAATAGCATCGGTTCCACCA
GTGCCTCTTCTGTCCCCAACACAGATGATGAGGACAGTGATTACCACCAGGAGGCCTACAAGGAGTCCTA
CAAAGACCGGCGGCGGCGCGCACACACTCAGGCTGAGCAGAAGAGGAGGGACGCCATCAAGAGAGGCTAT
GATGACCTTCAGACCATCGTCCCCACTTGCCAGCAGCAGGACTTCTCCATTGGCTCCCAAAAGCTCAGCA
AAGCCATCGTTCTACAAAAGACCATTGACTACATTCAGTTTTTGCACAAGGAGAAGAAAAAGCAGGAGGA
GGAGGTGTCCACGTTACGCAAGGATGTCACCGCCCTAAAGATCATGAAAGTGAACTATGAGCAGATTGTG
AAGGCACACCAGGACAACCCCCATGAAGGGGAGGACCAGGTCTCTGACCAGGTCAAGTTCAACGTGTTTC
AAGGCATCATGGATTCCCTGTTCCAGTCCTTCAATGCCTCCATCTCAGTGGCCAGCTTCCAGGAGCTGTC
AGCGTGTGTCTTCAGCTGGATCGAGGAGCACTGTAAGCCTCAGACCCTGCGGGAGATTGTGATTGGCGTC
CTGCACCAATTGAAAAACCAGCTTTACTGACCGGTTCTTGGAAACCTGGAGAACAGCCAACAAGAGGCCC
TTGAATCTCTACGTGGCCACTGAACTGCTGGGCCGGGAGACTGGACTACAACACCTCACACTGGTCAGC
TGGTTTCTACTTGGTGTTTGGTTTTTCCCAGCCCCATTTTATCTTCAGCGGAGCCGCGGTGTTTGTTTTG
TGAAAGCTTCTGATTAATTTATTATATTGACGATAAAACTCAAACCTACCCAGCCTTCCCCCCACTCCAT
GGAAGTCCTTGGGATGGGCGTCTGCTCTGGACACCCCAAAGAGCTCCTGCCCTCTCAGCCCTTTATTCAA
```

Figure 20 (Continued)

GCCTCAGATTTCTGCTCATGATCTACATAGATTTGGAAACTGTTTTCCTCTGTTTTGGTCTCTTGGGCAA
CATTTTTGGCCCAAGTTTGGGCAACATTTGGCCCAAGTTTGGGCATTTTGGCAGTAGCTGTATGGGAGAA
AAAGAGTAAGAGGAAATATTCCCACAGCCATGAAGGGTGAAAGGGCACCTTGTGCCTAGACTAGGGCTGC
CTGGTCAGTCCCAGGTGAGGCCAAGGGCTTTCTGGCCATCTCAGGGAGGGGCCACCAGGTTCCTCCCCTC
ACCCCATATTCCATCACCTTCCTCCTCTGCTCTGGGTGGTAAGGGAAGCCCTCCCGGTTCCCACAGGCTA
TGATGCTGCATGGCAGAGGCAGGTATAACACAGCACTACATATTGGAAATTTTTATTTTTCTAAATACC
AATGCAGTTTTGCTACGGTTACAATTTTGAAATATTAACTGAGCCTCAAAATCACCCTTTCTGTCAAGCA
TATCTTGGCCTCTCCCATGTCTCAGTGTTGCCTGCATTTCTCCCAGGACTTGGGGGTGGGGTGAAAAGCG
TACAAAAGATACTTAAAAGGGCTCCTGGGGTACACAAGCCCAGCAGGTCCTGAGTGAAGCCGTGGGCCCT
CCAAATGCTCGTTTTATAGCAACCTCTCTCTACCCTAGTTCTCCAAATTCACTTCTGCCTTCCTCAGGTT
TGATATCTGGCAGGTTTGACTATCCAGAGGAAATTAAATATTTTTATATAAAATTAAATTATAATAAATA
TTGCCAAATGCTTTCCTTTAGCATTGTTCCAAGTCTAAATGTTAACCTCAAGCTACTGCAATTTAGACAA
TGAAATGGGCTGGGTCTACCCCCAGCCACCAGCCCTCATCCTCTACCCAGTGCTCTGGTTTATGCTTG
TCTCCTGACTGCTCTGCTTAAAGGTGAAAGTAGCAGGAACAACAACAAAAGCCAACCAAAAACAAGGTAG
CCAGTGCAAGACATCTCACTCTTCTGACATCCTGCAGTCCCCACCAGTCCTGACCGTGGGCCCCTCAGGG
GTCTGGGAGTGTGACGTTGTAATCTTCATCCGTCTCTATCCCAACTTCCTCCTGTGAGACAGGGAGACAA
GTGAATGAGATGTCACCAGGATAAGACCACAGGGAAGCAAAGAAGGAAGAGAGCTCCACTTACAAAGAAC
TGCTTCTTGCTCTTGGGGTATCCTTCAAGTATTGCATCAGACAGCTCTGTAGCCTGACAAGAAATAAAAC
CACCCGTTTTCAGATGGGCAAAAAAA

>gi|48762676|ref|NM_198517.2| Homo sapiens TBC1 domain family, member 10C
(TBC1D10C), mRNA
GTGAGGTGCTGCGGGAGGCCCCGGGCACCATGGCCCAGGCCCTGGGGAGGACCTGGTGCAGCCTCCCGA
GCTGCAGGATGACTCCAGCTCCTTGGGGTCCGACTCAGAGCTCAGCGGGCCTGGCCCATATCGCCAGGCC
GACCGCTATGGATTCATTGGGGGCAGCTCAGCAGAGCCAGGGCCGGGCCACCCACCTGCAGACCTCATCC
GCCAACGGGAGATGAAGTGGGTGGAGATGACCTCGCACTGGGAGAAAACCATGTCCCGGCGGTACAAGAA
GGTAAAGATGCAGTGCCGGAAAGGCATCCCGTCTGCCCTGCGCGCCCGATGCTGGCCCCTGTTGTGTGGG
GCCCATGTGTGCCAGAAGAACAGCCCTGGCACCTATCAGGAGCTGGCAGAGGCCCCTGGAGACCCACAGT
GGATGGAGACCATTGGCAGGGACCTGCACCGTCAATTCCCTCTGCACGAGATGTTTGTGTCGCCTCAGGG
CCACGGGCAGCAGGGGCTCCTGCAGGTGCTCAAGGCCTACACCCTGTATCGACCGGAGCAGGGCTACTGC
CAGGCCCAGGGGCCCGTGGCTGCTGTGCTGCTCATGCACCTGCCCCCAGAGGAGGCCTTCTGGTGCCTGG
TGCAGATCTGTGAGGTCTACCTCCCTGGGTACTACGGGCCCCACATGGAGGCTGTGCGGCTGGACGCCGA
GGTGTTCATGGCCCTGCTGCGGCGGCTGCTTCCGCACGTGCACAAGCACCTGCAGCAGGTGGGCGTCGGA
CCCCTGCTGTACCTGCCCGAGTGGTTCCTGTGCCTCTTCGCCCGCTCCCTGCCCTTCCCCACAGTGCTGC
GTGTCTGGGATGCCTTCCTCAGTGAGGGTGCCAGAGTACTGTTCCGTGTGGGGCTGACACTGGTGCGCCT
GGCGCTGGGCACTGCAGAGCAGCGAGGGGCCTGCCCTGGCCTCCTGGAGACACTGGGAGCCCTTCGAGCC
ATCCCCCCGCGCAGCTGCAGGAGGAGGCCTTCATGTCACAGGTGCACAGCGTGGTGCTGTCAGAGCGGG
ACCTGCAGCGGGAGATCAAGGCCCAGCTGGCCCAGCTGCCCGATTCCGCGCCGGGACCCCCGCCCCGGCC
ACAGGTCCGCCTCGCCGGGGCCCAAGCCATCTTTGAGGCCCAGCAGCTGGCAGGAGTGCGACGAGGCGCC
AAGCCTGAGGTGCCTCGGATTGTGGTGCAGCCCCGGAGGAGCCCAGACCACCGCGGCGGAAACCCCAGA
CCCGCGGCAAGACTTTCCATGGGCTCCTGACTCGGGCCCGGGCCCCCCATCGAGGGGCCCCCAGGCC
CCAACGAGGCTCCACCTCCTTCCTGGACACCCGCTTCTGAGAGGACCATGGACTTAGTGTCCCCCAGTCT

Figure 20 (Continued)

```
CAATTGCCTGATGGCTGATGCCAGCCCGGCAAATAGGCACCGCACTTTACTCTTGGGACTCGGGGACTTG
GCTTCCTTCCTGGCAAGGACCAGGCAGTGGGGAAGGAGGAGGTCCTCCGTGGTACATACTGGGTCAGGCA
CTAGCATGGAGGAGGGTCACAGAGTGGGGCACGTGAGGACCCATGGAACCGTCCTGGTGCCCAGGCCCTC
ACAAGTACCAAAGCCAGCACCAAAGGAGTCAGGGAAGGGGTTGGCTGAGTCAAGGGACCCCAGAGGGCAC
CAGGAATAAAATCTTCTTGAACAGAAAAAAAAAAAAAAAAAAAAAAAAAAAAAAAAAAAAAAAAAAAAAA
AAAAAAAAAAAAAAAA

>gi|197100056|ref|NM_212535.2| Homo sapiens protein kinase C, beta (PRKCB),
transcript variant 1, mRNA
AGCTGGACGAGCGGCAGCAGCTGGGCGAGTGACAGCCCCGGCTCCGCGCGCCGCGGCCGCCAGAGCCGGC
GCAGGGGAAGCGCCCGCGGCCCCGGGTGCAGCAGCGGCCGCCGCCTCCCGCGCCTCCCCGGCCCGCAGCC
CGCGGTCCCGCGGCCCCGGGGCCGGCACCTCTCGGGCTCCGGCTCCCCGCGCGCAAGATGGCTGACCCGG
CTGCGGGGCCGCCGCCGAGCGAGGGCGAGGAGAGCACCGTGCGCTTCGCCCGCAAAGGCGCCCTCCGGCA
GAAGAACGTGCATGAGGTCAAGAACCACAAATTCACCGCCCGCTTCTTCAAGCAGCCCACCTTCTGCAGC
CACTGCACCGACTTCATCTGGGGCTTCGGGAAGCAGGGATTCCAGTGCCAAGTTTGCTGCTTTGTGGTGC
ACAAGCGGTGCCATGAATTTGTCACATTCTCCTGCCCTGGCGCTGACAAGGGTCCAGCCTCCGATGACCC
CCGCAGCAAACACAAGTTTAAGATCCACACGTACTCCAGCCCCACGTTTTGTGACCACTGTGGGTCACTG
CTGTATGGACTCATCCACCAGGGGATGAAATGTGACACCTGCATGATGAATGTGCACAAGCGCTGCGTGA
TGAATGTTCCCAGCCTGTGTGGCACGGACCACACGGAGCGCCGCGGCCGCATCTACATCCAGGCCCACAT
CGACAGGGACGTCCTCATTGTCCTCGTAAGAGATGCTAAAAACCTTGTACCTATGGACCCCAATGGCCTG
TCAGATCCCTACGTAAAACTGAAACTGATTCCCGATCCCAAAAGTGAGAGCAAACAGAAGACCAAAACCA
TCAAATGCTCCCTCAACCCTGAGTGGAATGAGACATTTAGATTTCAGCTGAAAGAATCGGACAAAGACAG
AAGACTGTCAGTAGAGATTTGGGATTGGGATTTGACCAGCAGGAATGACTTCATGGGATCTTTGTCCTTT
GGGATTTCTGAACTTCAGAAAGCCAGTGTTGATGGCTGGTTTAAGTTACTGAGCCAGGAGGAAGGCGAGT
ACTTCAATGTGCCTGTGCCACCAGAAGGAAGTGAGGCCAATGAAGAACTGCGGCAGAAATTTGAGAGGGC
CAAGATCAGTCAGGGAACCAAGGTCCCGGAAGAAAAGACGACCAACACTGTCTCCAAATTTGACAACAAT
GGCAACAGAGACCGGATGAAACTGACCGATTTTAACTTCCTAATGGTGCTGGGGAAAGGCAGCTTTGGCA
AGGTCATGCTTTCAGAACGAAAAGGCACAGATGAGCTCTATGCTGTGAAGATCCTGAAGAAGGACGTTGT
GATCCAAGATGATGACGTGGAGTGCACTATGGTGGAGAAGCGGGTGTTGGCCCTGCCTGGGAAGCCGCCC
TTCCTGACCCAGCTCCACTCCTGCTTCCAGACCATGGACCGCCTGTACTTTGTGATGGAGTACGTGAATG
GGGGCGACCTCATGTATCACATCCAGCAAGTCGGCCGGTTCAAGGAGCCCCATGCTGTATTTTACGCTGC
AGAAATTGCCATCGGTCTGTTCTTCTTACAGAGTAAGGGCATCATTTACCGTGACCTAAAACTTGACAAC
GTGATGCTCGATTCTGAGGGACACATCAAGATTGCCGATTTTGGCATGTGTAAGGAAAACATCTGGGATG
GGGTGACAACCAAGACATTCTGTGGCACTCCAGACTACATCGCCCCCGAGATAATTGCTTATCAGCCCTA
TGGGAAGTCCGTGGATTGGTGGGCATTTGGAGTCCTGCTGTATGAAATGTTGGCTGGGCAGGCACCCTTT
GAAGGGGAGGATGAAGATGAACTCTTCCAATCCATCATGGAACACAACGTAGCCTATCCCAAGTCTATGT
CCAAGGAAGCTGTGGCCATCTGCAAAGGGCTGATGACCAAACACCCAGGCAAACGTCTGGGTTGTGGACC
TGAAGGCGAACGTGATATCAAAGAGCATGCATTTTTCCGGTATATTGATTGGGAGAAACTTGAACGCAAA
GAGATCCAGCCCCCTTATAAGCCAAAAGCTAGAGACAAGAGAGACACCTCCAACTTCGACAAAGAGTTCA
CCAGACAGCCTGTGGAACTGACCCCCACTGATAAACTCTTCATCATGAACTTGGACCAAAATGAATTTGC
TGGCTTCTCTTATACTAACCCAGAGTTTGTCATTAATGTGTAGGTGAATGCAAACTCCATCGTTGAGCCT
GGGGTGTAAGACTTCAAGCCAAGCGTATGTATCAATTCTAGTCTTCCAGGATTCACGGTGCACATGCTGG
```

Figure 20 (Continued)

CATTCAACATGTGGAAAGCTTGTCTTAGAGGGCTTTTCTTTGTATGTGTAGCTTGCTAGTTTGTTTTCTA
CATTTGAAAATGTTTAGTTTAGAATAAGCGCATTATCCAATTATAGAGGTACAATTTTCCAAACTTCCAG
AAACTCATCAAATGAACAGACAATGTCAAAACTACTGTGTCTGATACCAAAATGCTTCAGTATTTGTAAT
TTTTCAAGTCAGAAGCTGATGTTCCTGGTAAAAGTTTTTACAGTTATTCTATAATATCTTCTTTGAATGC
TAAGCATGAGCGATATTTTTAAAAATTGTGAGTAAGCTTTGCAGTTACTGTGAACTATTGTCTCTTGGAG
GAAGTTTTTTGTTTAAGAATTGATATGATTAAACTGAATTAATATATGCAA

CANCER TREATMENT AND IMMUNE SYSTEM REGULATION THROUGH FAT10 PATHWAY INHIBITION

RELATED APPLICATIONS

This application is a national stage filing under 35 U.S.C. 371 of PCT/US2013/034950, filed Apr. 2, 2013, which claims the benefit of U.S. Provisional Application No. 61/619,091, filed Apr. 2, 2012, the content of which is expressly incorporated by reference herein in its entirety.

GOVERNMENT INTEREST

This invention was made with Government support under National Institutes of Health Grant R01 GM039023. The Government has certain rights in the invention.

The instant application contains a Sequence Listing which has been submitted electronically in ASCII format and is hereby incorporated by reference in its entirety. Said ASCII copy, created on Jan. 6, 2015, is named HMV-215.01_SL.txt and is 1,030,330 bytes in size.

BACKGROUND

The number of different proteins and protein isoforms in the human proteome is estimated to be about three orders of magnitude higher than the number of genes encoded in the genome. This diversity is largely due to post-translational modification of proteins, Such modifications can have a significant impact on protein function and stability.

The Ubiquitin-Like (Ubl) molecule family play a prominent role in post-transcriptional modification-based protein regulation. The Ubl molecule family are a class of evolutionarily conserved polypeptides that can be reversibly conjugated to lysine residues on the proteins they regulate through the formation of isopeptide bonds. The binding of a Ubl to a protein can affect the protein's activity, stability, cellular localization and/or its interaction with other proteins. Some Ubl conjugation pathways are known to be important in various human diseases, including in cancer, viral infection and neurodegenerative disorders. More than a dozen Ubl family members have been identified to date.

FAT10 is a Ubl that is homologous to di-ubiquitin and has been suggested to be the only Ubl modifier that targets proteins for degradation through conjugation. However, the only in vivo covalent substrates of FAT10 identified to date are Ube2z and p53. It is therefore unclear whether FAT10 acts as part of a signaling pathway or acts to funnel proteins to the proteasome for degradation. The role of FAT10 in human disease remains unknown.

SUMMARY

Provided herein are compositions and methods for the inhibition of mitosis, the inhibition of cellular proliferation, the induction of apoptosis, the treatment of cancer, the treatment of immune disorders and/or the identification of novel therapeutic agents.

In some embodiments, provided herein are methods for inhibiting mitosis, cellular proliferation and/or the induction of apoptosis in a cell. In some embodiments the methods described herein include contacting the cell with an agent that inhibits the FAT10 pathway in the cell (e.g., a cancer cell or an immune cell). In some embodiments the agent inhibits the FAT10 pathway by inhibiting the activity or expression of FAT10 in the cell. In some embodiments the cell is in a subject who has or is suspected of having cancer or an immune disorder. In some embodiments, the cell is subject to conditions that induce FAT10 expression, such as in the presence of pro-inflammatory cytokines.

In certain embodiments, provided herein are methods of treating cancer or an immune disorder in a subject. In some embodiments, the methods comprise the steps of administering to the subject an agent that inhibits the FAT10 pathway. In some embodiments the agent inhibits the FAT10 pathway by inhibiting the activity or expression of FAT10. In some embodiments the cancer is melanoma.

In certain embodiments of the methods described herein, the agent can be a small molecule, a polypeptide and/or an inhibitory nucleic acid. For example, the agent could be a small molecule that inhibits FAT10 activity or an inhibitory nucleic acid (e.g., siRNA, shRNA, antisense RNA) that is specific for FAT10 mRNA. In some embodiments the agent inhibits the formation of a conjugate between FAT10 and a FAT10 substrate (e.g., a FAT10 substrate encoded by a nucleic acid provided in FIG. 20).

In some embodiments, provided herein are methods for determining whether a test agent is a candidate therapeutic agent for treating cancer and/or immune disorders.

In some embodiments the method includes the steps of: a) forming a test reaction mixture comprising a FAT10 protein, a FAT10 substrate, a concentrated mammalian cell extract or a tissue sample (e.g., a tumor sample) and a test agent, b) incubating the test reaction under conditions conducive for the formation of a conjugate between the FAT10 protein and the FAT10 substrate (e.g., a FAT10 substrate encoded by a nucleic acid sequence provided in FIG. 20), and c) determining the amount of the conjugate in the test reaction mixture. In general, a test agent that reduces the amount of the conjugate in the test reaction mixture compared to the amount of the conjugate in a control reaction mixture is a candidate therapeutic agent for the treatment of cancer and/or immune disorders. The control reaction mixture can be, for example, a reaction mixture that is substantially identical to the test reaction mixture except that the control reaction mixture does not comprise a test agent or a reaction mixture that is substantially identical to the test reaction mixture except that the control reaction mixture comprises a placebo agent instead of a test agent. In some embodiments, the FAT10 protein and/or the FAT10 substrate is linked (directly or indirectly) to a detectable moiety. In some embodiments, the FAT10 protein and/or the FAT10 substrate is anchored (either directly or indirectly) to a solid support. In some embodiments, the FAT10/FAT10 substrate conjugate is isolated from unconjugated FAT10 protein and/or unconjugated FAT10 substrate.

In some embodiments the method includes the steps of: a) contacting a cell, a cell extract or a tissue sample (e.g., a tumor sample) with the test agent, and b) detecting the expression or activity of FAT10 in the cell, cell extract or tissue sample. In general, a test agent that decreases the expression or activity of FAT10 in a cell is a candidate therapeutic agent for treating cancer and/or immune disorders. In some embodiments, expression of FAT10 is detected in a cell by detecting FAT10 mRNA level or FAT10 protein level in the cell. In some embodiments, the activity of FAT10 is detected in a cell, cell extract or tissue sample by detecting a conjugate that includes FAT10 and a FAT10 substrate (e.g., a FAT10 substrate encoded by a nucleic acid provided in FIG. 20).

BRIEF DESCRIPTION OF THE DRAWINGS

FIG. 3 shows a list of the protein targets (by official gene symbol) that passed the reactivity threshold for each of the Ubl modifiers. Each column represents one Ubl. A shaded box indicates an interaction between the protein and the Ubl was detected, while a white box indicates that no interaction between the protein and Ubl was detected.

FIG. 6 shows an enrichment analyses of "molecular functions" among Ubl targets, assessed by over-representation of Gene Ontology (GO) terms for the targets of each Ubl and a detailed breakdown of the subset of 189 kinases in the network, and their Ubl specificities, showing an extensive crosstalk between kinases and different Ubl modifiers.

FIG. 9 shows that FAT10 targets are involved in cell cycle regulation and mitotic progression. (A) Signal intensity of FAT10ylated protein targets was measured under nocodazole arrest and upon release from mitotic arrest. Four different replicate spots for each substrate under the two conditions were compared using ANOVA and the resulting p-values indicating the significant change in Ubl modification were plotted (ascending order) for each Ubl separately. The two dotted lines indicate p-value cutoff levels of 0.1 and 0.05 as seen by the orange and brown lines. The y-axis denoted the cumulative number of target proteins that showed the stated significance in differential reactivity. (B) Duplicate spots of a FAT10 modified substrate under the two conditions, showing differences in reactivity.

FIG. 10 shows the effect of different conditions on FAT10ylation signal. (A) FAT10 signal intensity values of all proteins using two different antibodies (x-axis: peptide epitope, BioMol; y-axis: whole protein epitope, BioMol). (B) FAT10 signal intensity values of all proteins on the array with and without washes (3×) with 0.5% SDS.

FIG. 16 shows that inhibition of ube2z, the FAT10-conjugating enzyme or of FAT10 leads to prolonged mitotic arrest that is followed by apoptosis. (A) HeLa cells transfected with siRNA to ube2z or FAT10 exhibited prolonged arrest in mitosis when compared to control treated cells. (B) The arrest in mitosis led to cell death as can be seen by the reduced number of cells in the Ube2z or FAT10 siRNA treated cells. Three different examples are given for each condition.

FIG. 19 shows the nucleic acid sequence (A) and the amino acid sequence (B) of human FAT10 (SEQ ID NO: 1 and 2, respectively).

FIG. 20 shows the nucleic acid sequences that encode exemplary FAT10 substrates (SEQ ID NO: 3-282, respectively).

DETAILED DESCRIPTION

General

Figure 1:
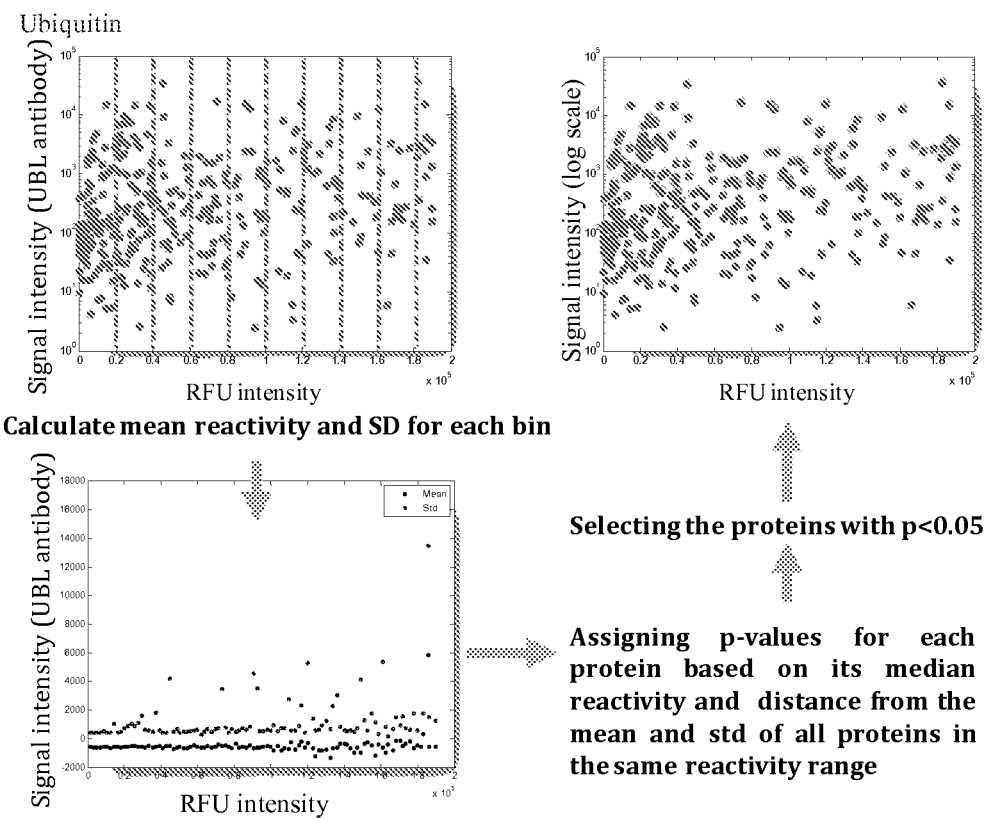
FIG. 1 shows an example of selecting the set of "reactive proteins" for ubiquitin. Signal intensity values (α-poly ubiquitin antibody; y-axis) were plotted against the RFU values (relative abundance on the chip; x-axis) for each spot. The RFU range was then divided into 100 equal-sized bins and the mean and SD intensity values for the spots in each bin were calculated. Based on the complementary error function each protein was assigned a p-value (FDR corrected) and proteins that had p<0.05 were selected (orange: p<0.05; blue: p>=0.05). Note that the y-axis for signal intensity is on a log scale.

Provided herein are compositions and methods for the inhibition of mitosis, the inhibition of cellular proliferation, the induction of apoptosis, the treatment of cancer, the treatment of immune disorders and/or the identification of novel therapeutic agents.

As described herein, analysis of Ubiquitin-like protein (Ubl) modification profiles upon cellular release from nocodazole arrest for Ubiquitin, SUMO1, SUMO2/3, NEDD8, UFM1, FAT10 and ISG15 showed that all but two Ubl pathways altered at least some of their targets during mitosis, indicating that post-transcriptional modification by Ubls plays an important role in mitotic regulation. Among the Ubls investigated, FAT10 exhibited the most dramatic changes in signal intensity and number of differentially-modified proteins. Although FAT10 itself was identified more than a decade ago, little is known about what it regulates. The experiments described herein identified a number of FAT10 substrates (e.g., those listed in FIGS. 3 and 10).

As described herein, the reactivity pattern of FAT10 was strikingly different from that of ubiquitin during the metaphase-anaphase transition. While the poly-ubiquitylation signal increases strongly, the FAT10 signal decreased for 76 out of 106 targets. In support of the importance of FAT10 in mitosis, inhibiting the FAT10 pathway by knocking-down FAT10 or its E2-conjugating enzyme (Ube2z) resulted in a clear prolongation of the mitotic arrest, followed by cell death. What is more, a significant fraction of the FAT10 pathway members identified in the studies described herein are important regulators of immune function and/or play a role in tumorigenesis and cancer pathogenesis. Examples of FAT10 pathway members that have an immune function are provided in Table 1. Thus, FAT10 is an attractive target for mitotic inhibition and the treatment of cancer and immune disorders.

TABLE 1

Exemplary FAT10 pathway members with immune function.

| Gene Symbol | Gene Function | Protein Seq. |
| --- | --- | --- |
| ELK3 | T cell activation | NP_005221.2 |
| GAL | alpha-beta T cell activation | NP_057057.2 |
| IGF2 | Immune response-regulating cell surface receptor signaling pathway | NP_000603.1 |
| ABCF1 | positive regulation of immune system process | NP_001020262.1 |
| POLR3C | regulation of immune effector process | NP_006459.3 |
| STAT6 | regulation of lymphocyte activation | NP_001171549.1 |
| AGER | regulation of leukocyte activation | NP_001127.1 |
| KIAA1715 | negative regulation of lymphocyte activation | NP_085153.1 |

TABLE 1-continued

Exemplary FAT10 pathway members with immune function.

| Gene Symbol | Gene Function | Protein Seq. |
| --- | --- | --- |
| SFXN1 | negative regulation of immune system process | NP_073591.2 |
| SDC1 | response to wounding | NP_001006947.1 |
| HP | defense response | NP_001119574.1 |
| TRAT1 | inflammatory response | NP_057472.2 |
| CLEC7A | regulation of lymphocyte activation | NP_072092.2 |
| HPR | T cell activation | NP_066275.3 |
| RPS6KB1 | alpha-beta T cell activation | NP_003152.1 |
| SMAD3 | regulation of leukocyte activation | NP_001138574.1 |
| ADORA2A | positive regulation of immune system process | NP_000666.2 |
| LAT | regulation of immune effector process | NP_001014987.1 |
| IL15 | regulation of lymphocyte proliferation | NP_000576.1 |
| MICB | positive regulation of B cell activation | NP_005922.2 |
| LIG3 | positive regulation of immune response | NP_002302.2 |
| SPAG11B | regulation of alpha-beta T cell activation | NP_057596.1 |
| HSH2D | positive regulation of lymphocyte activation | NP_116244.1 |
| MMP9 | immune system development | NP_004985.2 |
| SPAG11A | lymphocyte differentiation | NP_001075021.2 |
| GATA3 | T cell activation | NP_002042.1 |
| S100A12 | inflammatory response | NP_005612.1 |
| VEGFA | T cell activation | NP_001020537.2 |
| CCR9 | immune response | NP_001243298.1 |
| HDAC4 | B cell activation | NP_006028.2 |
| DHX58 | innate immune response | NP_077024.2 |
| IL32 | immune response | NP_001012649.1 |
| FKBP1B | T cell proliferation | NP_004107.1 |
| INS | alpha-beta T cell activation | NP_000198.1 |
| IL9 | immune response | NP_000581.1 |
| PRKCQ | positive regulation of T cell activation | NP_001229342.1 |
| NMI | inflammatory response | NP_004679.2 |
| BNIP3L | defense response to virus | NP_004322.1 |
| SYK | B cell receptor signaling pathway | NP_001128524.1 |
| CXorf9 | positive regulation of B cell proliferation | NP_061863.1 |
| VSTM3 | negative regulation of T cell activation | NP_776160.2 |
| IFNW1 | defense response | NP_002168.1 |
| DEFB4 | immune response | NP_004933.1 |
| PIK3R1 | T cell receptor signaling pathway | NP_001229395.1 |
| RSAD2 | defense response to virus | NP_542388.2 |

Thus, in certain embodiments described herein are methods of inhibiting mitosis, inhibiting proliferation and/or inducing apoptosis in a cell by contacting the cell with an agent that inhibits the FAT10 pathway, such as an agent that inhibits FAT10 expression and/or activity. In some embodiments, described herein are methods of treating cancer and/or immune disorders through the inhibition of the FAT10 pathway. In some embodiments described herein are methods of identifying mitotic inhibitors and/or potential cancer or immune disorder therapeutics by identifying agents that inhibit the FAT10 pathway, such as agents that inhibit FAT10 expression and/or activity.

Definitions

For convenience, certain terms employed in the specification, examples, and appended claims are collected here.

The articles "a" and "an" are used herein to refer to one or to more than one (i.e., to at least one) of the grammatical object of the article. By way of example, "an element" means one element or more than one element.

As used herein, the term "administering" means providing a pharmaceutical agent or composition to a subject, and includes, but is not limited to, administering by a medical professional and self-administering.

The term "agent" is used herein to denote a chemical compound, a small molecule, a mixture of chemical compounds, or a biological macromolecule. Agents may be identified as having a particular activity by screening assays described herein below. The activity of such agents may render them suitable as a "therapeutic agent" which is a biologically, physiologically, or pharmacologically active substance (or substances) that acts locally or systemically in a subject.

The term "amino acid" is intended to embrace all molecules, whether natural or synthetic, which include both an amino functionality and an acid functionality and capable of being included in a polymer of naturally-occurring amino acids. Exemplary amino acids include naturally-occurring amino acids; analogs, derivatives and congeners thereof; amino acid analogs having variant side chains; and all stereoisomers of any of any of the foregoing.

As used herein, the term "cancer" includes, but is not limited to, solid tumors and blood borne tumors. The term cancer includes diseases of the skin, tissues, organs, bone, cartilage, blood and vessels. The term "cancer" further encompasses primary and metastatic cancers.

The term "control" includes any portion of an experimental system designed to demonstrate that the factor being tested is responsible for the observed effect, and is therefore useful to isolate and quantify the effect of one variable on a system.

The term "FAT10 inhibitor" or "agent that inhibits FAT10" refers to an agent that decreases the level of FAT10 protein and/or decreases at least one activity of a FAT10 protein. In an exemplary embodiment, a FAT10-inhibing compound may decrease at least one biological activity of a FAT10 protein by at least about 10%, 25%, 50%, 75%, 100%, or more. Exemplary biological activities of FAT10 proteins include the formation of a conjugate between of FAT10 protein to FAT10 substrates (e.g., those encoded by SEQ ID NO: 3-282) and the proteasome-mediated degradation of FAT10 substrates.

The term "FAT10 pathway" refers to the network of interacting proteins regulated by FAT10 and proteins that regulate FAT10. Exemplary proteins that are components of the FAT10 pathway are provided in FIGS. 3 and 20. Members of the FAT10 pathway that regulate FAT10 activity include the E1 ligase Uba6 and the E2 ligase Ube2z.

As used herein, the term "immune cell" refers to the cells that make up the innate and the adaptive immune system. Exemplary immune cells include T cells, B cells, macrophages, dendritic cells, natural killer cells, monocytes, neutrophils, eosinophils, basophils and mast cells.

As used herein, the term "immune disorder" refers to any disease, disorder or disease symptom caused by an activity of the immune system, including autoimmune diseases, inflammatory diseases and allergies.

The terms "polynucleotide", and "nucleic acid" are used interchangeably. They refer to a polymeric form of nucleotides of any length, either deoxyribonucleotides or ribonucleotides, or analogs thereof. Polynucleotides may have any three-dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified, such as by conjugation with a labeling component. The term "recombinant" polynucleotide means a polynucleotide of genomic, cDNA, semisynthetic, or synthetic origin which either does not occur in nature or is linked to another polynucleotide in a non-natural arrangement.

A "patient" or "subject" refers to either a human or a non-human animal.

The term "small molecule" is art-recognized and refers to a composition which has a molecular weight of less than about 2000 amu, or less than about 1000 amu, and even less than about 500 amu. Small molecules may be, for example, nucleic acids, peptides, polypeptides, peptide nucleic acids, peptidomimetics, carbohydrates, lipids or other organic (carbon containing) or inorganic molecules. Many pharmaceutical companies have extensive libraries of chemical and/or biological mixtures, often fungal, bacterial, or algal extracts, which can be screened with any of the assays described herein. The term "small organic molecule" refers to a small molecule that is often identified as being an organic or medicinal compound, and does not include molecules that are exclusively nucleic acids, peptides or polypeptides.

The phrases "therapeutically-effective amount" and "effective amount" as used herein means that amount of a compound, material, or composition comprising a compound described herein which is effective for producing some desired therapeutic effect in at least a sub-population of cells in an animal at a reasonable benefit/risk ratio applicable to any medical treatment.

"Treating" a disease in a subject or "treating" a subject having a disease refers to subjecting the subject to a pharmaceutical treatment, e.g., the administration of a drug, such that at least one symptom of the disease is decreased or prevented from worsening.

FAT10 Proteins and FAT10 Substrate Proteins

As used herein, the term "FAT10" or "FAT10 protein" refers to the small, Ubiquitin-like modifier encoded in the major histocompatibility complex that is composed of two ubiquitin-like domains and possessing a free C-terminal diglycine motif, as well as functional domains, fragments (e.g., functional fragments), e.g., fragments of at least 8 amino acids, e.g., at least 8, 10, 20, 30, 40, 50, 60, 70, 80, 90, 100, 110 or 120 amino acids, and variants thereof. Exemplary functional fragments of FAT10 can, for example, form conjugates with FAT10 substrates and thereby regulate the stability and/or function of the FAT10 substrate. Exemplary FAT10 proteins include those having an amino acid sequence of SEQ ID NO: 2 (provided in FIG. 19). Homologs of FAT10 proteins will share 60%, 80%, 85%, 90%, 95%, 98%, 99% sequence identity to a known FAT10 protein and, e.g., form conjugates with FAT10 substrates. Variants of FAT10 proteins can be produced by standard means, including site-directed and random mutagenesis.

In certain embodiments, it may be advantageous to provide homologs of FAT10 protein that lack certain aspects of FAT10 activity. Such homologs may function as a modulator that inhibit a subset of the biological activities of naturally-occurring FAT10. For example, addition of two alanine residues to the C-terminus of FAT10 prevents it from conjugating with FAT10 substrates. Thus, antagonistic homologs may be generated which interfere with the ability of the wild-type FAT10 protein to associate with certain proteins (e.g., proteins that mediate the conjugation to FAT10 substrates).

As used herein, the term "FAT10 substrate" or "FAT10 substrate protein" refers to a protein that forms a conjugate with FAT10 during a natural biological process. Exemplary FAT10 substrates include those encoded by the nucleic acid sequences provided in FIG. 20 and SEQ ID NO: 3-282. In some embodiments, conjugation of FAT10 to a FAT10 substrate results in the proteasome-mediated degradation of the FAT10 substrate. FAT10 substrates are components of the FAT10 pathway.

In certain embodiments, a protein described herein is further linked to a heterologous polypeptide, e.g., a polypeptide comprising a domain which increases its solubility and/or facilitates its purification, identification, detection, and/or structural characterization. A protein described herein may be linked to at least 2, 3, 4, 5, or more heterologous polypeptides. Polypeptides may be linked to multiple copies of the same heterologous polypeptide or may be linked to two or more heterologous polypeptides. The proteins may also include linker sequences between a protein described herein and the fusion domain in order to facilitate construction of the fusion protein or to optimize protein expression or structural constraints of the fusion protein.

In another embodiment, a protein may be modified so that its rate of traversing the cellular membrane is increased. For example, the polypeptide may be fused to a second peptide which promotes "transcytosis," e.g., uptake of the peptide by cells. The peptide may be a portion of the HIV transactivator (TAT) protein, such as the fragment corresponding to residues 37-62 or 48-60 of TAT, portions which have been observed to be rapidly taken up by a cell in vitro (Green and Loewenstein, (1989) Cell 55:1179-1188). Alternatively, the internalizing peptide may be derived from the *Drosophila antennapedia* protein, or homologs thereof. The 60 amino acid long homeodomain of the homeo-protein antennapedia has been demonstrated to translocate through biological membranes and can facilitate the translocation of heterologous polypeptides to which it is coupled. Thus, the polypeptide may be fused to a peptide consisting of about amino acids 42-58 of *Drosophila antennapedia* or shorter fragments for transcytosis (Derossi et al. (1996) J Biol Chem 271:18188-18193; Derossi et al. (1994) J Biol Chem 269: 10444-10450; and Perez et al. (1992) J Cell Sci 102:717-722). The transcytosis polypeptide may also be a non-naturally-occurring membrane-translocating sequence (MTS), such as the peptide sequences disclosed in U.S. Pat. No. 6,248,558.

FAT10 Nucleic Acids and FAT10 Substrate Nucleic Acids

Nucleic acids encoding any of the proteins described herein (e.g. FAT10 and FAT10 substrates) are also provided herein. The nucleic acid sequence of human FAT10 is provided in FIG. 19 and SEQ ID NO: 1. The nucleic acid sequence of exemplary FAT10 substrates are provided in FIG. 20 and SEQ ID NO: 3-282. Such a nucleic acid may further be linked to a promoter and/or other regulatory sequences, as further described herein. Exemplary nucleic acids are those that are at least about 80%, 85%, 90%, 95%, 98%, 99% or 100% identical to a nucleotide sequence provided herein or a fragment thereof, such as nucleic acid sequence encoding the protein fragments described herein. Nucleic acids may also hybridize specifically, e.g., under stringent hybridization conditions, to a nucleic acid described herein or a fragment thereof.

Nucleic acids, e.g., those encoding a protein described above, a functional homolog thereof, or a nucleic acid intended to inhibit the production of a protein of interest (e.g., siRNA, shRNA or antisense RNA, described in greater detail below) can be delivered to cells in culture, ex vivo, and in vivo. The delivery of nucleic acids can be by any technique known in the art including viral mediated gene transfer, liposome mediated gene transfer, direct injection into a target tissue, organ, or tumor, injection into vasculature which supplies a target tissue or organ.

Polynucleotides can be administered in any suitable formulations known in the art. These can be as virus particles, as naked DNA, in liposomes, in complexes with polymeric carriers, etc. Polynucleotides can be administered to the arteries which feed a tissue or tumor.

Nucleic acids can be delivered in any desired vector. These include viral or non-viral vectors, including adenovirus vectors, adeno-associated virus vectors, retrovirus vectors, lentivirus vectors, and plasmid vectors. Exemplary types of viruses include HSV (herpes simplex virus), AAV (adeno associated virus), HIV (human immunodeficiency virus), BIV (bovine immunodeficiency virus), and MLV (murine leukemia virus). Nucleic acids can be administered in any desired format that provides sufficiently efficient delivery levels, including in virus particles, in liposomes, in nanoparticles, and complexed to polymers.

A polynucleotide of interest can also be combined with a condensing agent to form a gene delivery vehicle. The condensing agent may be a polycation, such as polylysine, polyarginine, polyornithine, protamine, spermine, spermidine, and putrescine. Many suitable methods for making such linkages are known in the art.

In an alternative embodiment, a polynucleotide of interest is associated with a liposome to form a gene delivery vehicle. Liposomes are small, lipid vesicles comprised of an aqueous compartment enclosed by a lipid bilayer, typically spherical or slightly elongated structures several hundred Angstroms in diameter. Under appropriate conditions, a liposome can fuse with the plasma membrane of a cell or with the membrane of an endocytic vesicle within a cell which has internalized the liposome, thereby releasing its contents into the cytoplasm. Prior to interaction with the surface of a cell, however, the liposome membrane acts as a relatively impermeable barrier which sequesters and protects its contents, for example, from degradative enzymes. Additionally, because a liposome is a synthetic structure, specially designed liposomes can be produced which incorporate desirable features. See Stryer, Biochemistry, pp. 236-240, 1975 (W.H. Freeman, San Francisco, Calif.); Szoka et al., Biochim. Biophys. Acta 600:1, 1980; Bayer et al., Biochim. Biophys. Acta. 550:464, 1979; Rivnay et al., Meth. Enzymol. 149:119, 1987; Wang et al., PROC. NATL. ACAD. SCI. U.S.A. 84: 7851, 1987, Plant et al., Anal. Biochem. 176:420, 1989, and U.S. Pat. No. 4,762,915. Liposomes can encapsulate a variety of nucleic acid molecules including DNA, RNA, plasmids, and expression constructs comprising growth factor polynucleotides such those described herein Liposomal preparations for use in the methods described herein include cationic (positively charged), anionic (negatively charged) and neutral preparations. Cationic liposomes have been shown to mediate intracellular delivery of plasmid DNA (Felgner et al., Proc. Natl. Acad. Sci. USA 84:7413-7416, 1987), mRNA (Malone et al., Proc. Natl. Acad. Sci. USA 86:6077-6081, 1989), and purified transcription factors (Debs et al., J. Biol. Chem. 265:10189-10192, 1990), in functional form. Cationic liposomes are readily available. For example, N[1-2,3-dioleyloxy)propyl]-N,N,N-triethylammonium (DOTMA) liposomes are available under the trademark Lipofectin, from GIBCO BRL, Grand Island, N.Y. See also Felgner et al., Proc. Natl. Acad. Sci. USA 91: 5148-5152.87, 1994. Other commercially available liposomes include Transfectace (DDAB/DOPE) and DOTAP/DOPE (Boerhinger). Other cationic liposomes can be prepared from readily available materials using techniques well known in the art. See, e.g., Szoka et al., Proc. Natl. Acad. Sci. USA 75:4194-4198, 1978; and WO 90/11092 for descriptions of the synthesis of DOTAP (1,2-bis(oleoyloxy)-3-(trimethylammonio)propane) liposomes.

Similarly, anionic and neutral liposomes are readily available, such as from Avanti Polar Lipids (Birmingham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

Inhibitors of the FAT10 Pathway

Certain embodiments described herein relate to methods of inhibiting mitosis, inhibiting cellular proliferation, causing apoptosis, treating cancer and/or treating an immune disorder. These methods involve administering an agent that inhibits the FAT10 pathway. For example, such agents may inhibit the activity and/or expression of FAT10. Agents which may be used to inhibit the FAT10 pathway and/or FAT10 include proteins, peptides, small molecules and inhibitory RNA molecules, e.g., siRNA molecules, shRNA, ribozymes, and antisense oligonucleotides.

Any agent that inhibits FAT10 and/or the FAT10 pathway can be used to practice certain methods described herein. Such agents can be those described herein, those known in the art, or those identified through screening assays (e.g. the screening assays described herein).

In some embodiments, assays used to identify agents useful in the methods described herein include a reaction between FAT10 and one or more assay components. The other components may be, for example, a test agent (e.g. the potential agent), or a combination of a test agent and a FAT10 substrate (e.g. the FAT10 substrates provided in FIGS. 3 and 20). Agents identified via such assays, such as those described herein, may be useful, for example, for inhibiting mitosis, treating cancer or treating immune disorders.

Agents useful in the methods described herein may be obtained from any available source, including systematic libraries of natural and/or synthetic compounds. Agents may also be obtained by any of the numerous approaches in combinatorial library methods known in the art, including: biological libraries; peptoid libraries (libraries of molecules having the functionalities of peptides, but with a novel, non-peptide backbone which are resistant to enzymatic degradation but which nevertheless remain bioactive; see, e.g., Zuckermann et al., 1994, *J. Med. Chem.* 37:2678-85); spatially addressable parallel solid phase or solution phase libraries; synthetic library methods requiring deconvolution; the 'one-bead one-compound' library method; and synthetic library methods using affinity chromatography selection. The biological library and peptoid library approaches are limited to peptide libraries, while the other four approaches are applicable to peptide, non-peptide oligomer or small molecule libraries of compounds (Lam, 1997, *Anticancer Drug Des.* 12:145).

Examples of methods for the synthesis of molecular libraries can be found in the art, for example in: DeWitt et al. (1993) *Proc. Natl. Acad. Sci. U.S.A.* 90:6909; Erb et al. (1994) *Proc. Natl. Acad. Sci. USA* 91:11422; Zuckermann et al. (1994). *J. Med. Chem.* 37:2678; Cho et al. (1993) *Science* 261:1303; Carrell et al. (1994) *Angew. Chem. Int. Ed. Engl.* 33:2059; Carell et al. (1994) *Angew. Chem. Int. Ed. Engl.* 33:2061; and in Gallop et al. (1994)*J. Med. Chem.* 37:1233.

Libraries of agents may be presented in solution (e.g., Houghten, 1992, *Biotechniques* 13:412-421), or on beads (Lam, 1991, *Nature* 354:82-84), chips (Fodor, 1993, *Nature* 364:555-556), bacteria and/or spores, (Ladner, U.S. Pat. No. 5,223,409), plasmids (Cull et al, 1992, *Proc Natl Acad Sci USA* 89:1865-1869) or on phage (Scott and Smith, 1990, *Science* 249:386-390; Devlin, 1990, *Science* 249:404-406; Cwirla et al, 1990, *Proc. Natl. Acad. Sci.* 87:6378-6382; Felici, 1991, *J. Mol. Biol.* 222:301-310; Ladner, supra.).

Agents useful in the methods described herein may be identified, for example, using assays for screening candidate or test compounds which inhibit the formation of a conjugate between FAT10 or a biologically active portion thereof and a FAT10 substrate.

In some embodiments, the assay systems used to identify compounds that modulate the activity of FAT10 involves preparing a reaction mixture containing FAT10 and a FAT10 substrate under conditions and for a time sufficient to allow FAT10 to conjugate to its substrate. For example, such conditions can be established through the use of a concentrated cell extract. Use of such extracts are described, for example, in the exemplification and in Merbl and Kirschner, *Proc Natl Acat Sci USA* 106:2543-2548 (2009), which is hereby incorporated by reference in its entirety. In some embodiments a tissue sample, such as a tumor sample, is used to establish conditions to facilitate conjugation of FAT10 to its substrate. In some embodiments, the FAT10 and/or the FAT10 substrate is linked, either directly or indirectly, to a detectable moiety (e.g., a radioactive, fluorescent, luminescent and/or enzymatic moiety) to facilitate its detection. In order to test an agent for activity, a reaction mixture is prepared in the presence of the compound and a control reaction mixture is prepared in the absence of the test compound. The control reaction mixture may also contain a placebo agent. The test compound can be initially included in the reaction mixture, or can be added at a time subsequent to the addition of FAT10 and its substrate. Control reaction mixtures are incubated without the test compound or with a placebo. The conjugation of the substrate by FAT10 is then detected. Substrate conjugation can be detected by any method known in the art including, but not limited to, using anti-FAT10 antibodies and/or detectably labeled FAT10 and/or substrate to detect the level of conjugation. Conjugation of the substrate in the control reaction, but less or no such conjugation in the reaction mixture containing the test compound, indicates that the compound decreases with the activity of FAT10.

The assay for agents that inhibit the interaction of FAT10 with its binding partner may be conducted in a heterogeneous or homogeneous format. Heterogeneous assays involve anchoring either FAT10 or its substrate onto a solid phase and detecting conjugates anchored to the solid phase at the end of the reaction. In homogeneous assays, the entire reaction is carried out in a liquid phase. In either approach, the order of addition of reactants can be varied to obtain different information about the agents being tested. For example, test compounds that interfere with the interaction between FAT10 and the binding partner (e.g., by competition) can be identified by conducting the reaction in the presence of the test substance, i.e., by adding the test substance to the reaction mixture prior to or simultaneously with FAT10 and its interactive binding partner. Alternatively, test compounds that disrupt preformed conjugates can be tested by adding the test compound to the reaction mixture after conjugates have been formed. The various formats are briefly described below.

In a heterogeneous assay system, either FAT10 or its substrate is anchored onto a solid surface or matrix, while the other corresponding non-anchored component may be labeled, either directly or indirectly. In practice, microtitre plates are often utilized for this approach. The anchored species can be immobilized by a number of methods, either non-covalent or covalent, that are well known in the art. Non-covalent attachment can often be accomplished simply by coating the solid surface with a solution of FAT10 or its substrate and drying. Alternatively, an immobilized antibody specific for the assay component to be anchored can be used for this purpose.

A homogeneous assay may also be used to identify inhibitors of FAT10. This is typically a reaction, analogous to those mentioned above, which is conducted in a liquid phase in the presence or absence of the test agent. The formed conjugates are then separated from unconjugated components, and the amount of conjugate formed is determined. As mentioned for heterogeneous assay systems, the order of addition of reactants to the liquid phase can yield information about which test compounds inhibit conjugate formation and which disrupt preformed conjugates.

In such a homogeneous assay, the reaction products may be separated from unreacted assay components by any of a number of standard techniques, including but not limited to: differential centrifugation, chromatography, electrophoresis and immunoprecipitation. In differential centrifugation, conjugates of molecules may be separated from unconjugated molecules through a series of centrifugal steps, due to the different sedimentation equilibria of conjugates based on their different sizes and densities (see, for example, Rivas, G., and Minton, A. P., *Trends Biochem Sci* 1993 August; 18(8):284-7). Standard chromatographic techniques may also be utilized to separate conjugated molecules from unconjugated ones. For example, gel filtration chromatography separates molecules based on size, and through the utilization of an appropriate gel filtration resin in a column format, for example, the relatively larger conjugate may be separated from the relatively smaller unconjugated components. Immunoprecipitation is another common technique utilized for the isolation of a protein-protein conjugates from solution (see, e.g., Ausubel et at (eds.), In: *Current Protocols in Molecular Biology*, J. Wiley & Sons, New York. 1999). In this technique, all proteins binding to an antibody specific to one of the binding molecules are precipitated from solution by conjugating the antibody to a bead that may be readily collected by centrifugation or through the application of a magnetic field. The bound assay components may be released from the beads, and a second immunoprecipitation step performed, this time utilizing antibodies specific for the correspondingly different interacting assay component. Alternatively, the presence of the second assay component in the immunoprecipitated fraction can detected directly using a detectable label, for example, a detectable label linked either directly or indirectly to FAT10 or its substrate.

In another embodiment, agents useful in the methods described herein may be identified using assays for screening candidate or test compounds which bind to FAT10 or a biologically active portion thereof. Determining the ability of the test agent to directly bind to FAT10 can be accomplished, for example, by coupling the compound with a detectable label such that binding of the compound to FAT10 can be determined by detecting the labeled compound in a complex. For example, compounds can be labeled with $^{125}$I, $^{35}$S, $^{14}$C, $^{3}$H, either directly or indirectly, and the radioisotope detected by direct counting of radioemission or by scintillation counting. Alternatively, assay components can be enzymatically labeled with, for example, horseradish peroxidase, alkaline phosphatase, or luciferase, and the enzymatic label detected by determination of conversion of an appropriate substrate to product.

Modulators of FAT10 expression may also be identified, for example, using methods wherein a cell is contacted with a candidate compound and the expression of FAT10 mRNA or protein is determined. The level of expression of mRNA or protein in the presence of the candidate compound is compared to the level of expression of mRNA or protein in the absence of the candidate compound. The candidate compound can then be identified as a modulator of FAT10 expression based on this comparison. For example, when expression of FAT10 is greater in the presence of the candidate compound than in its absence, the candidate compound is identified as a stimulator of FAT10 mRNA or protein expression. Conversely, when expression of FAT10 is less in the presence of the candidate compound than in its absence, the candidate compound is identified as an inhibitor of FAT10 mRNA or protein expression.

Inhibitory Nucleic Acid Molecules

In certain embodiments, inhibitory nucleic acid molecules that specifically target FAT10 mRNA or FAT10 pathway component mRNA (e.g., antisense molecules, siRNA or shRNA molecules, ribozymes or triplex molecules) are used in methods described herein. Such molecules are useful, for example, in methods of inhibiting mitosis, inhibiting proliferation, inducing apoptosis, treating cancer and/or treating immune disorders.

The inhibitory nucleic acid molecules described herein may be contacted with a cell or administered to an organism. Alternatively, constructs encoding these may be contacted with or introduced into a cell or organism. Antisense constructs, antisense oligonucleotides, RNA interference constructs or siRNA duplex RNA molecules can be used to interfere with expression of a protein of interest, e.g., a FAT10 protein and/or a FAT10 substrate protein. Typically at least 15, 17, 19, or 21 nucleotides of the complement of the FAT10 mRNA sequence are sufficient for an antisense molecule. Typically at least 19, 21, 22, or 23 nucleotides of a target sequence are sufficient for an RNA interference molecule. The RNA interference molecule may have a 2 nucleotide 3' overhang. If the RNA interference molecule is expressed in a cell from a construct, for example from a hairpin molecule or from an inverted repeat of the desired sequence, then the endogenous cellular machinery will create the overhangs. RNA interference molecules may include DNA residues, as well as RNA residues.

Inhibitory nucleic acid molecules can be prepared by chemical synthesis, in vitro transcription, or digestion of long dsRNA by Rnase III or Dicer. These can be introduced into cells by transfection, electroporation, or other methods known in the art. See Hannon, G J, 2002, RNA Interference, Nature 418: 244-251; Bernstein E et al., 2002, The rest is silence. RNA 7: 1509-1521; Hutvagner G et al., RNAi: Nature abhors a double-strand. Curr. Opin. Genetics & Development 12: 225-232; Brummelkamp, 2002, A system for stable expression of short interfering RNAs in mammalian cells. Science 296: 550-553; Lee N S, Dohjima T, Bauer G, Li H, Li M-J, Ehsani A, Salvaterra P, and Rossi J. (2002). Expression of small interfering RNAs targeted against HIV-1 rev transcripts in human cells. Nature Biotechnol.

20:500-505; Miyagishi M, and Taira K. (2002). U6-promoter-driven siRNAs with four uridine 3' overhangs efficiently suppress targeted gene expression in mammalian cells. Nature Biotechnol. 20:497-500; Paddison P J, Caudy A A, Bernstein E, Hannon G J, and Conklin D S. (2002). Short hairpin RNAs (shRNAs) induce sequence-specific silencing in mammalian cells. Genes & Dev. 16:948-958; Paul C P, Good P D, Winer I, and Engelke D R. (2002). Effective expression of small interfering RNA in human cells. Nature Biotechnol. 20:505-508; Sui G, Soohoo C, Affar E-B, Gay F, Shi Y, Forrester W C, and Shi Y. (2002). A DNA vector-based RNAi technology to suppress gene expression in mammalian cells. Proc. Natl. Acad. Sci. USA 99(6):5515-5520; Yu J-Y, DeRuiter S L, and Turner D L. (2002). RNA interference by expression of short-interfering RNAs and hairpin RNAs in mammalian cells. Proc. Natl. Acad. Sci. USA 99(9):6047-6052.

In the present methods, an inhibitory nucleic acid molecule or an inhibitory nucleic acid encoding polynucleotide can be administered to the subject, for example, as naked RNA, in combination with a delivery reagent, and/or as a nucleic acid comprising sequences that express the siRNA or shRNA molecules. In some embodiments the nucleic acid comprising sequences that express the siRNA or shRNA molecules are delivered within vectors, e.g. plasmid, viral and bacterial vectors. Any nucleic acid delivery method known in the art can be used in the methods described herein. Suitable delivery reagents include, but are not limited to, e.g., the Minis Transit TKO lipophilic reagent; lipofectin; lipofectamine; cellfectin; polycations (e.g., polylysine), atelocollagen, nanoplexes and liposomes. The use of atelocollagen as a delivery vehicle for nucleic acid molecules is described in Minakuchi et al. Nucleic Acids Res., 32(13):e109 (2004); Hanai et al. Ann NY Acad Sci., 1082:9-17 (2006); and Kawata et al. Mol Cancer Ther., 7(9):2904-12 (2008); each of which is incorporated herein in their entirety.

In some embodiments of the methods described herein, liposomes are used to deliver an inhibitory oligonucleotide to a subject. Liposomes suitable for use in the methods described herein can be formed from standard vesicle-forming lipids, which generally include neutral or negatively charged phospholipids and a sterol, such as cholesterol. The selection of lipids is generally guided by consideration of factors such as the desired liposome size and half-life of the liposomes in the blood stream. A variety of methods are known for preparing liposomes, for example, as described in Szoka et al. (1980), Ann. Rev. Biophys. Bioeng. 9:467; and U.S. Pat. Nos. 4,235,871, 4,501,728, 4,837,028, and 5,019,369, the entire disclosures of which are herein incorporated by reference.

The liposomes for use in the present methods can also be modified so as to avoid clearance by the mononuclear macrophage system ("MMS") and reticuloendothelial system ("RES"). Such modified liposomes have opsonization-inhibition moieties on the surface or incorporated into the liposome structure.

Opsonization-inhibiting moieties for use in preparing the liposomes described herein are typically large hydrophilic polymers that are bound to the liposome membrane. As used herein, an opsonization inhibiting moiety is "bound" to a liposome membrane when it is chemically or physically attached to the membrane, e.g., by the intercalation of a lipid-soluble anchor into the membrane itself, or by binding directly to active groups of membrane lipids. These opsonization-inhibiting hydrophilic polymers form a protective surface layer that significantly decreases the uptake of the liposomes by the MMS and RES; e.g., as described in U.S. Pat. No. 4,920,016, the entire disclosure of which is herein incorporated by reference.

Opsonization inhibiting moieties suitable for modifying liposomes are preferably water-soluble polymers with a number-average molecular weight from about 500 to about 40,000 daltons, and more preferably from about 2,000 to about 20,000 daltons. Such polymers include polyethylene glycol (PEG) or polypropylene glycol (PPG) derivatives; e.g., methoxy PEG or PPG, and PEG or PPG stearate; synthetic polymers such as polyacrylamide or poly N-vinyl pyrrolidone; linear, branched, or dendrimeric polyamidoamines; polyacrylic acids; polyalcohols, e.g., polyvinylalcohol and polyxylitol to which carboxylic or amino groups are chemically linked, as well as gangliosides, such as ganglioside GM1. Copolymers of PEG, methoxy PEG, or methoxy PPG, or derivatives thereof, are also suitable. In addition, the opsonization inhibiting polymer can be a block copolymer of PEG and either a polyamino acid, polysaccharide, polyamidoamine, polyethyleneamine, or polynucleotide. The opsonization inhibiting polymers can also be natural polysaccharides containing amino acids or carboxylic acids, e.g., galacturonic acid, glucuronic acid, mannuronic acid, hyaluronic acid, pectic acid, neuraminic acid, alginic acid, carrageenan; aminated polysaccharides or oligosaccharides (linear or branched); or carboxylated polysaccharides or oligosaccharides, e.g., reacted with derivatives of carbonic acids with resultant linking of carboxylic groups. Preferably, the opsonization-inhibiting moiety is a PEG, PPG, or derivatives thereof. Liposomes modified with PEG or PEG-derivatives are sometimes called "PEGylated liposomes."

Pharmaceutical Compositions

Pharmaceutical compositions described herein include any inhibitor of the FAT10 pathway, such as an inhibitor of FAT10 activity or, or a pharmaceutically acceptable salt thereof, and a pharmaceutically acceptable carrier or vehicle. The pharmaceutical compositions may further include additional agents for the treatment of cancer and/or immune disorders. Pharmaceutical compositions described herein are useful for inhibiting mitosis, treating cancer and/or treating immune disorders.

A pharmaceutical composition described herein is formulated to be compatible with its intended route of administration. Examples of routes of administration include parenteral, intravenous, intradermal, subcutaneous, oral, transdermal (topical), transmucosal, and rectal administration.

Toxicity and therapeutic efficacy of the agents described herein can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. While compounds that exhibit toxic side effects can be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the ED50 with little or no toxicity. The dosage may vary within this range depending upon the dosage form employed and the route of administration utilized. For any compound used in the methods described herein, the therapeutically effective dose can be estimated initially from cell culture assays. A dose can be formulated in animal models to achieve a circulating plasma concentration range that includes the IC50 (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

Appropriate dosage agents depends upon a number of factors within the scope of knowledge of the ordinarily skilled physician, veterinarian, or researcher. The dose(s) of the small molecule will vary, for example, depending upon the identity, size, and condition of the subject or sample being treated, further depending upon the route by which the composition is to be administered.

Therapeutic Methods

Provided herein are methods of treatment of diseases and disorders that can be improved by disrupting the FAT10 pathway. In some embodiments, described herein, are therapeutic methods of treating cancer, including a cancerous tumor, comprising administering to a subject, (e.g., a subject in need thereof), an effective amount of an agent that inhibits FAT10 and/or the FAT10 pathway. In some embodiments, described herein, are therapeutic methods of treating an immune disorder (e.g., an autoimmune disease, an inflammatory disease and/or an allergy), comprising administering to a subject, (e.g., a subject in need thereof), an effective amount of an agent that inhibits FAT10 and/or the FAT10 pathway.

The pharmaceutical compositions described herein can be delivered by any suitable route of administration, including orally, nasally, as by, for example, a spray, rectally, intravaginally, parenterally, intracisternally and topically, as by powders, ointments or drops, including buccally and sublingually. In certain embodiments the pharmaceutical compositions are delivered generally (e.g., via oral or parenteral administration). In certain other embodiments the pharmaceutical compositions are delivered locally through direct injection into a tumor by direct injection into the tumor's blood supply (e.g., arterial or venous blood supply).

In certain embodiments, the methods of treatment described herein include administering an agent that inhibits FAT10 and/or the FAT10 pathway in conjunction with a second therapeutic agent to the subject. For example, when used for treating cancer, such methods may comprise administering pharmaceutical compositions described herein in conjunction with one or more chemotherapeutic agents and/or scavenger compounds, including chemotherapeutic agents described herein, as well as other agents known in the art. When used to treat immune disorders, such methods may include administering pharmaceutical compositions described herein in conjunction with one or more agents useful for the treatment of immune disorders, such as immunosuppressants or other therapeutic agents known in the art.

Conjunctive therapy includes sequential, simultaneous and separate, or co-administration of the active compound in a way that the therapeutic effects of the first agent administered have not entirely disappeared when the subsequent agent is administered. In certain embodiments, the second agent may be co-formulated with the first agent or be formulated in a separate pharmaceutical composition.

In some embodiments, the subject pharmaceutical compositions described herein will incorporate the substance or substances to be delivered in an amount sufficient to deliver to a patient a therapeutically effective amount of an incorporated therapeutic agent or other material as part of a prophylactic or therapeutic treatment. The desired concentration of the active compound in the particle will depend on absorption, inactivation, and excretion rates of the drug as well as the delivery rate of the compound. It is to be noted that dosage values may also vary with the severity of the condition to be alleviated. It is to be further understood that for any particular subject, specific dosage regimens should be adjusted over time according to the individual need and the professional judgment of the person administering or supervising the administration of the compositions. Typically, dosing will be determined using techniques known to one skilled in the art.

In certain embodiments, described herein are therapeutic methods of treating cancer in a subject in need thereof. A subject in need thereof may include, for example, a subject who has been diagnosed with a tumor, including a pre-cancerous tumor, a cancer, or a subject who has been treated, including subjects that have been refractory to the previous treatment.

The methods described herein may be used to treat any cancerous or pre-cancerous tumor. In certain embodiments, the tumor has increased expression of FAT10 protein or mRNA relative to non-tumor tissue (e.g., a non-tumor tissue of the same tissue type as the tumor). Cancers that may treated, prevented or diagnosed by methods and compositions described herein include, but are not limited to, cancer cells from the bladder, blood, bone, bone marrow, brain, breast, colon, esophagus, gastrointestine, gum, head, kidney, liver, lung, nasopharynx, neck, ovary, prostate, skin, stomach, testis, tongue, or uterus. In addition, the cancer may specifically be of the following histological type, though it is not limited to these: neoplasm, malignant; carcinoma; carcinoma, undifferentiated; giant and spindle cell carcinoma; small cell carcinoma; papillary carcinoma; squamous cell carcinoma; lymphoepithelial carcinoma; basal cell carcinoma; pilomatrix carcinoma; transitional cell carcinoma; papillary transitional cell carcinoma; adenocarcinoma; gastrinoma, malignant; cholangiocarcinoma; hepatocellular carcinoma; combined hepatocellular carcinoma and cholangiocarcinoma; trabecular adenocarcinoma; adenoid cystic carcinoma; adenocarcinoma in adenomatous polyp; adenocarcinoma, familial polyposis coli; solid carcinoma; carcinoid tumor, malignant; branchiolo-alveolar adenocarcinoma; papillary adenocarcinoma; chromophobe carcinoma; acidophil carcinoma; oxyphilic adenocarcinoma; basophil carcinoma; clear cell adenocarcinoma; granular cell carcinoma; follicular adenocarcinoma; papillary and follicular adenocarcinoma; nonencapsulating sclerosing carcinoma; adrenal cortical carcinoma; endometroid carcinoma; skin appendage carcinoma; apocrine adenocarcinoma; sebaceous adenocarcinoma; ceruminous adenocarcinoma; mucoepidermoid carcinoma; cystadenocarcinoma; papillary cystadenocarcinoma; papillary serous cystadenocarcinoma; mucinous cystadenocarcinoma; mucinous adenocarcinoma; signet ring cell carcinoma; infiltrating duct carcinoma; medullary carcinoma; lobular carcinoma; inflammatory carcinoma; paget's disease, mammary; acinar cell carcinoma; adenosquamous carcinoma; adenocarcinoma w/squamous metaplasia; thymoma, malignant; ovarian stromal tumor, malignant; thecoma, malignant; granulosa cell tumor, malignant; and roblastoma, malignant; sertoli cell carcinoma; leydig cell tumor, malignant; lipid cell tumor, malignant; paraganglioma, malignant; extra-mammary paraganglioma, malignant; pheochromocytoma; glomangiosarcoma; malignant melanoma; amelanotic melanoma; superficial spreading melanoma; malig melanoma in giant pigmented nevus;

epithelioid cell melanoma; blue nevus, malignant; sarcoma; fibrosarcoma; fibrous histiocytoma, malignant; myxosarcoma; liposarcoma; leiomyosarcoma; rhabdomyosarcoma; embryonal rhabdomyosarcoma; alveolar rhabdomyosarcoma; stromal sarcoma; mixed tumor, malignant; mullerian mixed tumor; nephroblastoma; hepatoblastoma; carcinosarcoma; mesenchymoma, malignant; brenner tumor, malignant; phyllodes tumor, malignant; synovial sarcoma; mesothelioma, malignant; dysgerminoma; embryonal carcinoma; teratoma, malignant; struma ovarii, malignant; choriocarcinoma; mesonephroma, malignant; hemangiosarcoma; hemangioendothelioma, malignant; kaposi's sarcoma; hemangiopericytoma, malignant; lymphangiosarcoma; osteosarcoma; juxtacortical osteosarcoma; chondrosarcoma; chondroblastoma, malignant; mesenchymal chondrosarcoma; giant cell tumor of bone; ewing's sarcoma; odontogenic tumor, malignant; ameloblastic odontosarcoma; ameloblastoma, malignant; ameloblastic fibrosarcoma; pinealoma, malignant; chordoma; glioma, malignant; ependymoma; astrocytoma; protoplasmic astrocytoma; fibrillary astrocytoma; astroblastoma; glioblastoma; oligodendroglioma; oligodendroblastoma; primitive neuroectodermal; cerebellar sarcoma; ganglioneuroblastoma; neuroblastoma; retinoblastoma; olfactory neurogenic tumor; meningioma, malignant; neurofibrosarcoma; neurilemmoma, malignant; granular cell tumor, malignant; malignant lymphoma; Hodgkin's disease; Hodgkin's lymphoma; paragranuloma; malignant lymphoma, small lymphocytic; malignant lymphoma, large cell, diffuse; malignant lymphoma, follicular; mycosis fungoides; other specified non-Hodgkin's lymphomas; malignant histiocytosis; multiple myeloma; mast cell sarcoma; immunoproliferative small intestinal disease; leukemia; lymphoid leukemia; plasma cell leukemia; erythroleukemia; lymphosarcoma cell leukemia; myeloid leukemia; basophilic leukemia; eosinophilic leukemia; monocytic leukemia; mast cell leukemia; megakaryoblastic leukemia; myeloid sarcoma; and hairy cell leukemia.

In some embodiments, described herein are therapeutic methods for treating an immune disorder. Such methods can be used to treat any immune disorder, including an autoimmune disease (e.g., Lupus, Scleroderma, hemolytic anemia, vasculitis, type one diabetes, Grave's disease, rheumatoid arthritis, multiple sclerosis, Goodpasture's syndrome, pernicious anemia and/or myopathy), an inflammatory disease (e.g., acne vulgaris, asthma, celiac disease, chronic prostatitis, glomerulonephritis, inflammatory bowel disease, pelvic inflammatory disease, reprofusion injury, rheumatoid arthritis, sarcoidosis, transplant rejection, vasculitis and/or interstial cystitis), and/or an allergy (e.g., food allergies, drug allergies and/or environmental allergies).

All publications, including patents, applications, and GenBank Accession numbers mentioned herein are hereby incorporated by reference in their entirety as if each individual publication or patent was specifically and individually indicated to be incorporated by reference. In case of conflict, the present application, including any definitions herein, will control.

The invention now being generally described, it will be more readily understood by reference to the following examples, which are included merely for purposes of illustration of certain aspects and embodiments of the present invention, and are not intended to limit the invention.

EXEMPLIFICATION

Materials and Methods

HeLa S3 cells were synchronized in prometaphase by treatment with nocodazole. Cells were incubated in thymidine-containing (2 mM) medium for 24 hours. Cells were released into fresh medium for 8 hours, followed by a nocodazole arrest (0.1 µg/mL) for 12 hours. Cells were harvested, washed with PBS, and processed for extraction.

To deplete FAT10 and Ube2z, Dharmacon siGENOME SMARTpool against FAT10 or Ube2z (M-008266-03 and M-008596-02, respectively), were used in all experiments at a final concentration of 20 nM. As a control Dharmacon siGENOME Non-Targeting siRNA Pool #1 and #2 were used at 20 nM (D-001206-13-05 and D-001206-14-05, respectively). siRNA transfection was performed using Oligofectamine (Invitrogen) according to the manufacturer's instructions.

Cells were seeded in glass-bottom plates (MatTek) in $CO_2$-independent medium (Invitrogen) supplemented with 10 FBS, 100 U/ml penicillin and 100 µg/ml streptomycin. For fluorescent time-lapse imaging cells were seeded in phenol red-free $CO_2$-independent medium (Invitrogen). Image acquisition was performed using Nikon TE2000 automated inverted microscope with a 20 objective enclosed in a humidified incubation chamber maintained at 37° C. Images were collected every 15 minutes using a motorized stage. Images were viewed and analyzed using MetaMorph software (Molecular Dynamics).

Extracts were prepared as described in Merbl and Kirschner, *Proc Natl Acad Sci USA* 106:2543-2548 (2009), Rape and Kirschner, *Nature* 432:588-595 (2004) and Storey et al., *Biostatistics* 8:414-432 (2007), each of which is incorporated by reference in its entirety. and incubated on microarrays as described in Merbl and Kirschner, *Proc Natl Acad Sci USA* 106:2543-2548 (2009) with the following primary antibodies: polyubiquitin antibody (FK1; Biomol), SUMO2/3 (Cell Signaling), NEDD8 (Cell signaling), FAT10 (Enzo life sciences), SUMO1 (Cell signaling), UFM1 (BioMol) and ISG15 (Cell signaling). Antibodies were diluted 1:250 and detected using fluorescently-labeled secondary antibodies.

The Degradation assay was performed as described in Williamson et al., *Methods Mol Biol* 545:301-312, which is incorporated by reference in its entirety.

For microarray scanning and data processing, Images were acquired using a GenePix 4000B scanner and processed as described in Merbl and Kirschner, *Proc Natl Acad Sci USA* 106:2543-2548 (2009).

For Constructing the Ubl network, data were normalized using the quantile normalization algorithm for each modification separately. In order to establish an unbiased method for identifying the reactive proteins in each Ubl reactivity profile, the signal intensity of each protein was plotted as a function of their corresponding RFU and binned into 100 bins along the RFU range. The RFU value was determined during the quality control procedure for each 'batch' of microarray production. Since every protein that is spotted on the array is expressed and purified with a GST tag, amount of material in each spot can be estimated based on the reactivity value towards a labeled anti-GST antibody. Thus, using both the signal intensity value and the amount of protein in each spot the set of targets for each Ubl was identified. Next, in order to establish an unbiased method for identifying the reactive proteins in each Ubl reactivity profile, the signal intensity of each protein was plotted as a function of their corresponding RFU values and binned into 100 bins along the RFU range (see FIG. 1). The mean value and standard deviation (SD) of the signal intensities in each bin were calculated and the best fit line of each measure was calculated using linear least square regression analysis. The distance of the SD from the line for each bin was calculated. Based on the complementary error function a p-value was assigned for each protein and a threshold level of p<0.01 (after false discovery rate (FDR) correction) was set in order to identify the reactive targets from each Ubl profile.

The mean value and SD of the signal intensities in each bin were calculated and the best fit line of each measure was calculated using linear least square regression analysis. The distance of the SD from the line for each bin was calculated. Based on the complementary error function:

$$erfc(x) = 1 - erf(x)$$
$$= \frac{2}{\sqrt{\pi}} \int_x^\infty e^{-t^2} dt.$$

a p-value was assigned for each protein. The error function represents the probability that the parameter of interest is within a range between $-x/\sigma\sqrt{2}$ and $x/\sigma\sqrt{2}$, while the complementary error function provides the probability that the parameter is outside that range. A threshold level of p<0.01 (after false discovery rate (FDR) correction) was set in order to select the set of 'positive' targets from each Ubl profile. A total of 1543 target proteins passed the threshold for at least one of the modifications.

To identify Ubl targets that are differentially modified upon mitotic release, the reactivity level of each protein was compared in different conditions using the ANOVA test (4 duplicate spots per condition). Significance was determined based on Storey's p value correction.

The in vitro SUMOylation analysis was performed as follows. E1, and E2 enzymes were added to a S35-radioactively labeled substrate with recombinant SUMO1, SUMO2 or SUMO3. The reaction was supplemented with ATP and allowed to run in room temperature for 2 hours. As a negative control, the same reaction is performed without the addition of the E1 enzyme and ran for the same amount of time (the right lane of each gel). Reactions are stopped by addition of sample buffer containing 5% β-mercaptoethanol. To identify modified substrates the samples were analyzed by SDS-PAGE and phosphorimaging. The formation of a higher molecular-weight species (ladder) signifies the substrate's modification.

Example 1

Global Identification of Ubiquitin and Ubl Targets in Mitosis

Figure 2:
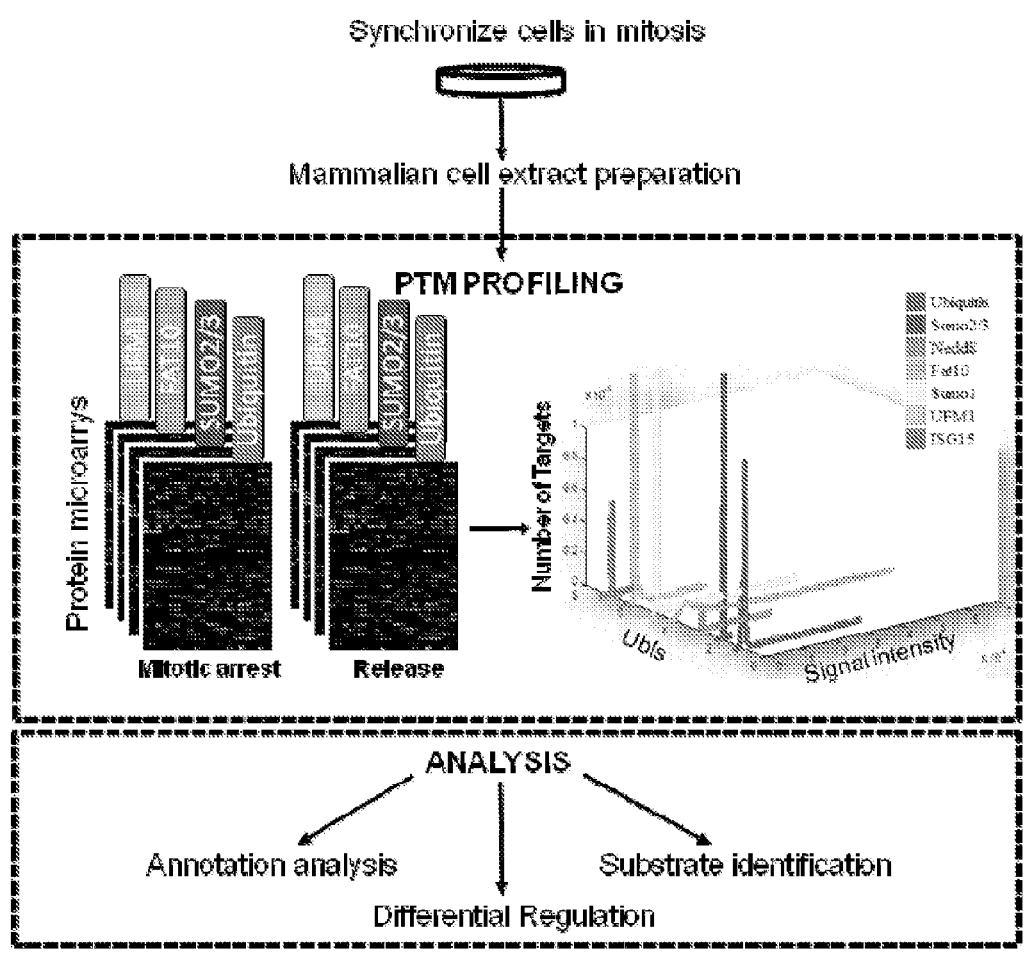
FIG. 2 shows the experimental design for the Ubl modification assay. Mitotic HeLa S3 cell extract were incubated on protein microarrays with or without the addition of Ubch10, a protein that abrogates the checkpoint arrest and allows the extracts to proceed toward mitotic exit. Ubl modifications on the spotted proteins are then measured by labeling the arrays with UBL-specific antibodies, and fluorescently-labeled secondary antibodies are used to quantify the reactivity profile of the ~8000 proteins on the array toward each Ubl modification.

An assay in which concentrated cell extracts were applied directly to microarrays and the modification of a subset of proteins was determined using modification-specific antibodies was used to explore the role of several ubiquitin-like modifications (Ubiquitin, SUMO2/3, NEDD8, FAT10, SUMO1, UFM1 and ISG15) in mitotic regulation. For these seven modifications, the modification state of thousands of proteins before and after release from mitotic arrest were profiled (FIG. 2). These extracts promote full checkpoint arrest and APC inhibition and to be relieved of that inhibition by Ubch10. Extracts were applied to duplicate microarrays for each modification under each of two conditions: 'arrested' (blocked in mitosis with nocadazole) and 'released' (released into anaphase/G1 from that block by Ubch10) for a total of 28 microarrays. The mean reactivity of each target protein was then calculated from four replicate spots (2 spots per array×2 replicates).

The subsequent analysis focused on highly reactive proteins, defined as having a specific reactivity greater than 2 standard deviations above the mean for each Ubl modification (when normalized to the protein abundance on the chip; see materials and methods and FIG. 1). All proteins passing these criteria also have a reactivity significantly higher than the background reactivity of negative control spots, which contain either no protein, or else the GST-tag alone, or bovine serum albumin. Each Ubl reacted with 158-506 proteins that exhibited Ubl reactivity greater than the threshold. 1543 such target proteins highly reactive to at least one of the Ubls were identified (FIG. 3). For ubiquitin, which is the most investigated protein in this family, approximately 70% of the targets previously identified were confirmed either in vitro or in vivo as ubiquitylation substrates. Thus, the false-negative rate of the assay was low.

Example 2

The Ubl Modification Network

Figure 4:
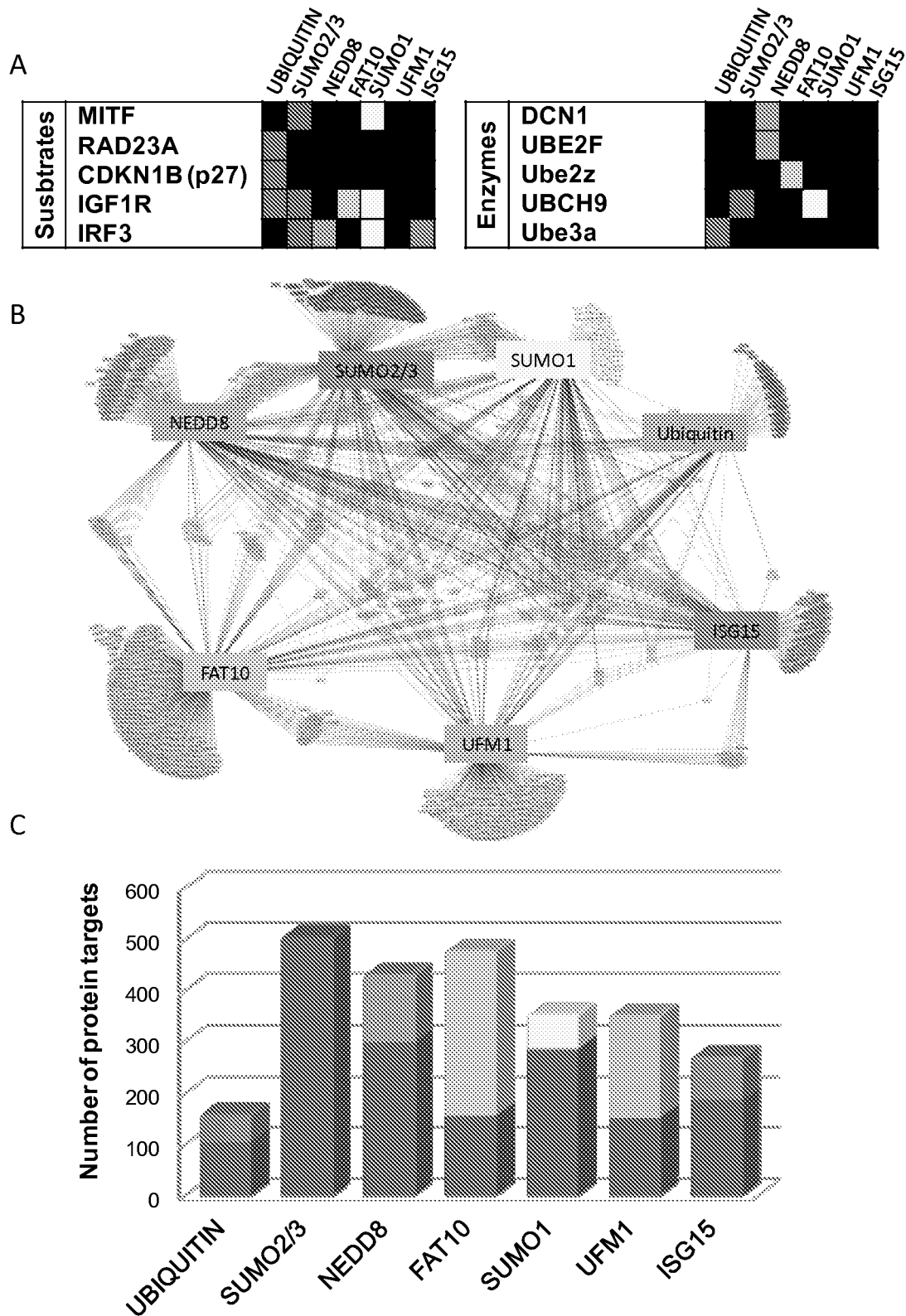
FIG. 4A shows examples of known Ubl targets and Ubl pathway enzymes identified by the assay. A grey box denotes reactivity toward that Ubl, while a black box indicates no interaction.
FIG. 4B shows the Ubl interaction network. Each protein is connected to the Ubl with which it interacts. Proteins that have multiple Ubls interactions are shown at the center and proteins that are reactive exclusively with one Ubl are shown at the rim.
FIG. 4C shows the number of proteins targeted by each Ubl showing specificity of the Ubl pathways.

Each reactive protein target's interaction with each of the seven Ubl modifications were characterized (FIG. 3). Some proteins are reactive to just one Ubl (e.g. Rad23a. which exhibited high reactivity only towards ubiquitin), while others react with multiple Ubls (e.g. IgfIR). Several examples of such interactions were previously reported and are shown in FIG. 4A. Among these, a few have been identified only recently.

To identify global patterns of Ubl modifications, the different targets for each Ubl were mapped into an "interaction network" (FIG. 4B). The network consists of seven hubs, corresponding to the Ubls, and multiple nodes representing each one of the target proteins. Edges between the hubs and nodes represent the PTM interactions. The network reveals the interaction of the different Ubls with their targets, and their degree of specificity. Most of the Ubl targets (65% of 1543) map just to a single Ubl (FIG. 4B, proteins assembled at the rim of the graph), whereas the remaining targets (35%) map to at least two Ubls (proteins in the center of the graph). Thus, most proteins are regulated primarily by one Ubl, though this varied from Ubl to Ubl. For example, only 20% were unique to SUMO1, whereas 68% of FAT10 targets were unique to FAT10 (FIG. 4C).

The network (FIG. 4B) reveals that, a large number of target proteins interact with multiple Ubls, with a few (2.6%) interacting with five or more modifications (nodes in the center of the network). This pattern suggests that there is considerable specificity in Ubl modification.

Figure 5:
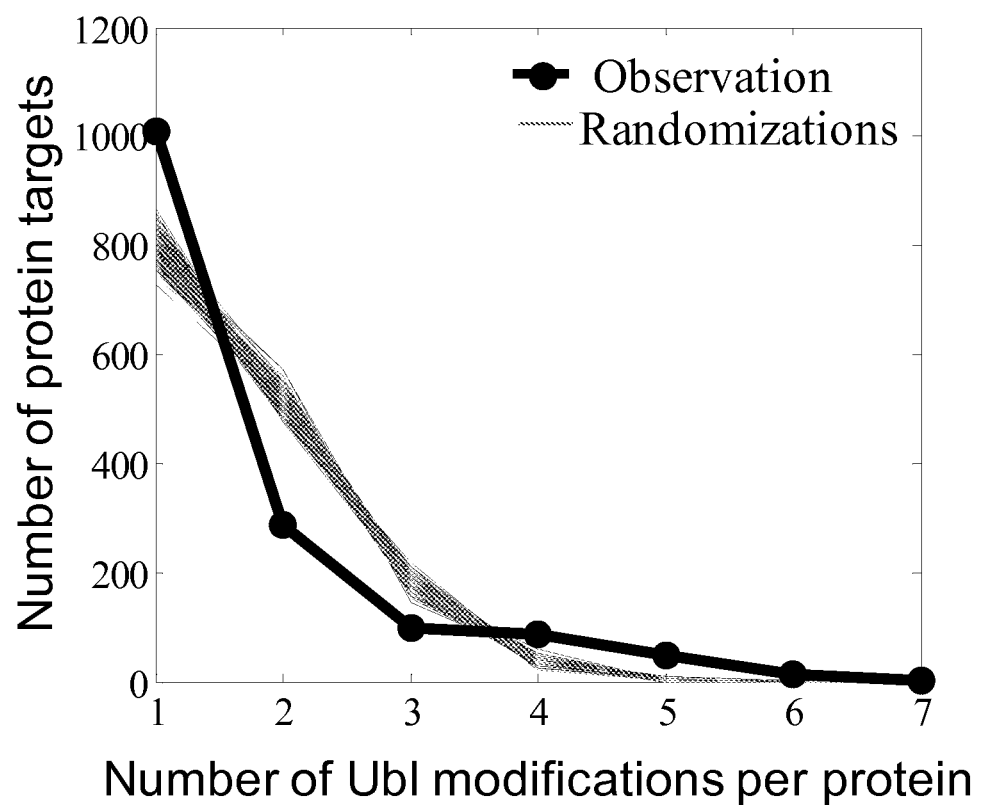
FIG. 5 shows a comparison of the observed distribution of Ubl reactivities with expected distribution for a random Ubl network

To characterize the statistical implications of a network of seven independent Ubl modifications, the fraction of nodes (protein targets), $F_n$, with $1 \leq n \leq 7$ edges connecting them to hubs corresponding to the seven Ubl modifications were considered. If the different Ubl modifications were independent of each other, then $F_n$ should correspond to a multinomial distribution, where the edges from each of the seven hubs is assigned to targets at random. To test whether this is the case, 5000 random permutations of the network that preserved the number of edges from each hub were generated, and the resulting edge distribution $F_n$ to the empirical data were compared (FIG. 5). The analysis shows that the number of unique targets $F_1$ (proteins targeted by only one Ubl), was higher than would be expected by chance (65% observed versus 52±1.4% expected), while the fraction $F_2$ of doubly-modified targets was much lower than expected by chance (19% observed versus 34±1% expected). Therefore, on average, the subset of doubly-modified targeted proteins ($F_2$) appear to be anti-correlated: a protein modified by one Ubl is less likely to be targeted by another.

The low abundance of doubly-modified targets suggests that certain Ubl combinations might be permitted while the majority is not (FIG. 5). A pair-wise correlation analysis of Ubl modifications confirmed that, indeed, most of the possible double Ubl interactions are strongly suppressed. However, certain Ubl combinations are over-represented in the correlation map, indicating that certain Ubls often co-target the same substrates. For example, there was high correlation between SUMO1 and SUMO2/3 targets (R=0.58), as well as between UFM1 and FAT10 modifications (R=0.63).

The enrichment of the network for exclusive Ubl targets ($F_1$) can be studied by comparing specific Ubl reactivity combinations to the predictions of randomized permutations. Since 7 Ubls were profiled, 127 ($2^7-1$) possible "reactivity states" for different Ubls combinations/patterns were identified. For single-targeted proteins, only FAT10 and UFM1 exhibited a higher frequency of exclusive targets compared to random: 324 unique FAT10 targets were observed when 161 were expected, and 202 UFM1 targets were observed compared to 108 expected, suggesting that the functions of the FAT10 and UFM1 systems are largely insulated from the activity of other Ubls. The other Ubls (e.g. ubiquitin, SUMO1, SUMO2/3) exhibited the same frequency of exclusive targets as would be expected by chance, suggesting that these parallel pathways evolved independently. Thus, the over-representation of unique substrates is largely dominated by UFM1 and FAT10.

Example 3

Cellular and Functional Classification of Ubl Targets

Figure 7:
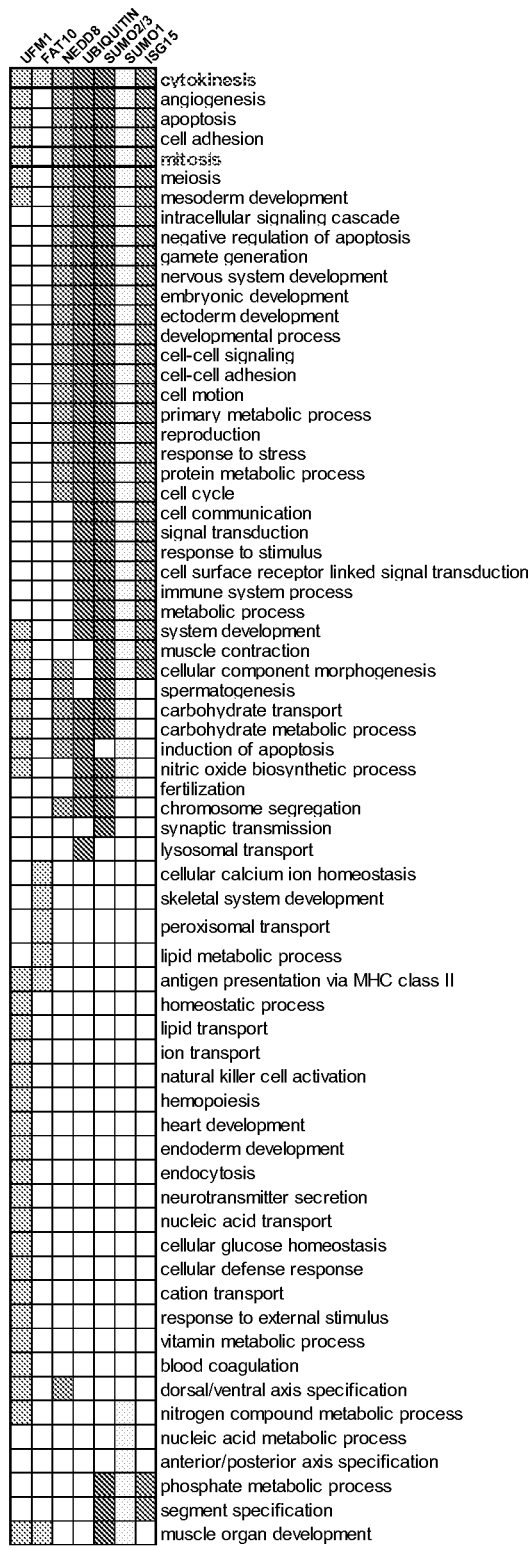
FIG. 7 shows an enrichment analyses of "biological processes" among Ubl targets.

To examine whether the different Ubl pathways might be targeted to specific categories of proteins, or associated with distinct classes of biological processes, over-represented Gene Ontology (GO) terms for Ubl target protein annotations were identified using the Panther database (http://www.pantherdb.org). For each Ubl, the enrichment for GO terms identified with its substrates was determined. Functional terms were scored based on their enrichment compared to the complete list of target proteins with significant enrichment determined by p-value<0.1 (corrected for false discovery rate). By comparing the targets of each Ubl to the list of reactive proteins only, false-positive enrichments that could arise from biases in the representation of protein subsets on the chip were limited. FIG. 6 presents the molecular functions (the function that the protein performs on its direct molecular targets) related to the targets of each Ubl, while FIG. 7 presents the biological processes (the systems to which the protein contributes). Each column represents one Ubl (with enriched terms shaded).

The only over-represented categories in the cell cycle were 'mitosis' and 'cytokinesis', indicating that the assay preferentially identified proteins involved in mitotic regulation. Known biological functions of Ubiquitin and SUMO were enriched (FIG. 6). For example, ubiquitylation targets are the only ones enriched for the 'Ubiquitin ligase activity' term, with numerous targets categorized as E3 ligases or 'ring finger' proteins. In addition, SUMO1 and SUMO2/3 targets are uniquely enriched for transcriptional-related terms and DNA binding corresponding to their role in transcriptional regulation.

The assay revealed a class of 'translation initiation factors' targeted by the ISG15 modification (FIG. 3). UFM1 targets were enriched in transmembrane transporters, ion channels and cytokine receptors, and FAT10 targets were enriched for SNAP receptors, proteins related to extracellular matrix activity and DNA helicases.

Figure 8:
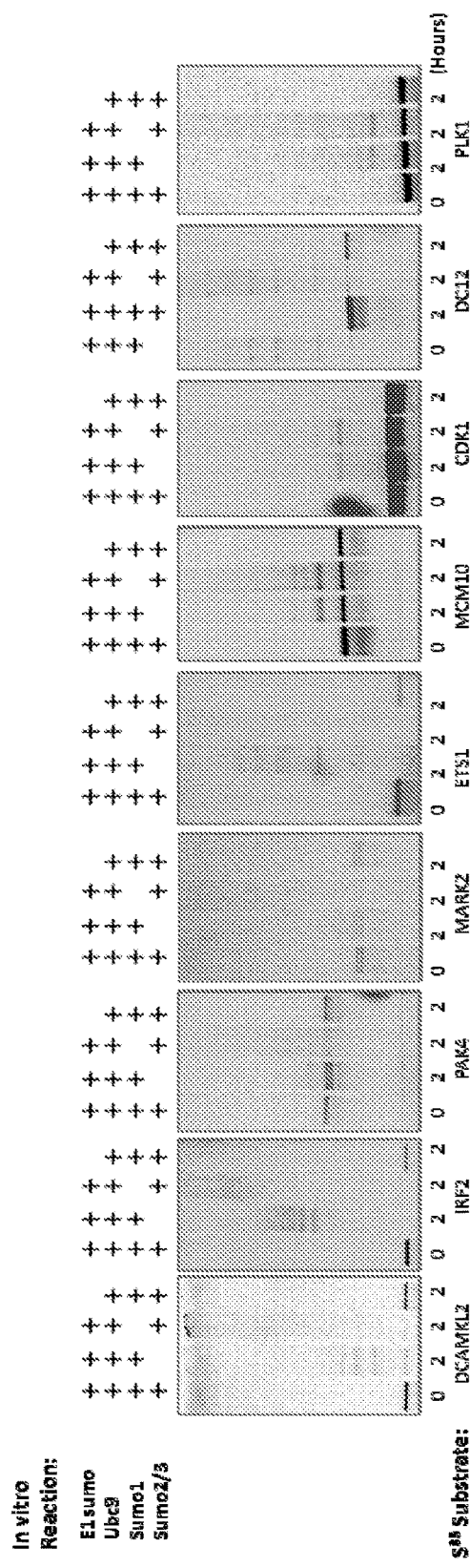
FIG. 8 shows the validation of in vitro SUMOylation of known and predicted kinases. Each reaction was performed by adding a S35-labeled substrate into a test tube containing E1, E2, ATP and either recombinant SUMO1, SUMO2 proteins. Reactions were carried out for 2 hours at room temperature. Negative control (right lane of each gel) was performed under the same conditions without adding the E1 enzyme.

Kinases were enriched in the set of Ubl targets (FIG. 6). Specifically, SUMO1 and SUMO2/3 together targeted 181 of the 189 kinases (FIG. 6) that were reactive in the assay. Among these, 20 known mitotic kinases were found. The SUMOylation of Polo-like kinase 1 (Plk1) and Cyclin dependent kinase-1 (Cdk1) as well as other kinases were confirmed in vitro (FIG. 8).

Many of the Ubls were implicated in a common set of biological processes (FIG. 7) that include cell cycle regulation, apoptosis, angiogenesis, cell adhesion and embryonic development. FAT10 and UFM1 are the exceptions: FAT10 targets were over-represented in 'antigen processing and presentation via MHC class II' and 'cellular calcium homeostasis', while UFM1 targets were implicated in pathways classified as 'endocytosis', 'hemopoeisis', 'neurotransmitter secretion' and 'lipid transport'. Both FAT10 and UFM1 also had a significant number of targets in the mitosis/cytokinesis pathways. For example, 27 of the proteins modified by FAT10 were cell cycle regulators, 19 of which were mitosis-related.

Example 4

Differential Regulation of FAT10 Upon Release from Mitotic Arrest

To examine prometaphase arrest to anaphase/G1 under conditions that minimized variation in the extracts, a nocodazole-arrested HeLa cell extract (checkpoint arrested; denoted 'arrested') was compared with the same extract supplemented with the E2 enzyme, Ubch10, which relieves mitotic arrest (denoted as 'released') and drives the cell into anaphase and G1. The reactivity level of each protein towards each of the Ubls was calculated for these two conditions, using two microarrays per condition. An ANOVA test performed for the reactivity of each protein under these conditions (whose p-values were corrected using Storey's false discovery rate method) showed that the reactivity for both ubiquitin and FAT10 had the most significant changes (q-value<0.1) upon release from the arrested into the released state (FIG. 9A).

FIG. 9B depicts examples of FAT10 reactivity levels for several proteins under the two conditions. Most of these statistically significant changes in FAT10 level represented dramatic decreases of two to three orders of magnitude. This effect could not be explained by the variability of the assay and persisted if different antibodies were used (FIG. 10, top) or more stringent washing conditions were used (FIG. 10, bottom). Thus, 106 proteins showed a significant difference, either an increase in FAT10ylation (30 proteins) or a decrease (76 proteins), between the arrested and released conditions in FAT10 reactivity patterns (q<0.002).

Example 5

FAT10 is Involved in Cell Cycle Regulation and Mitotic Progression

Figure 11:
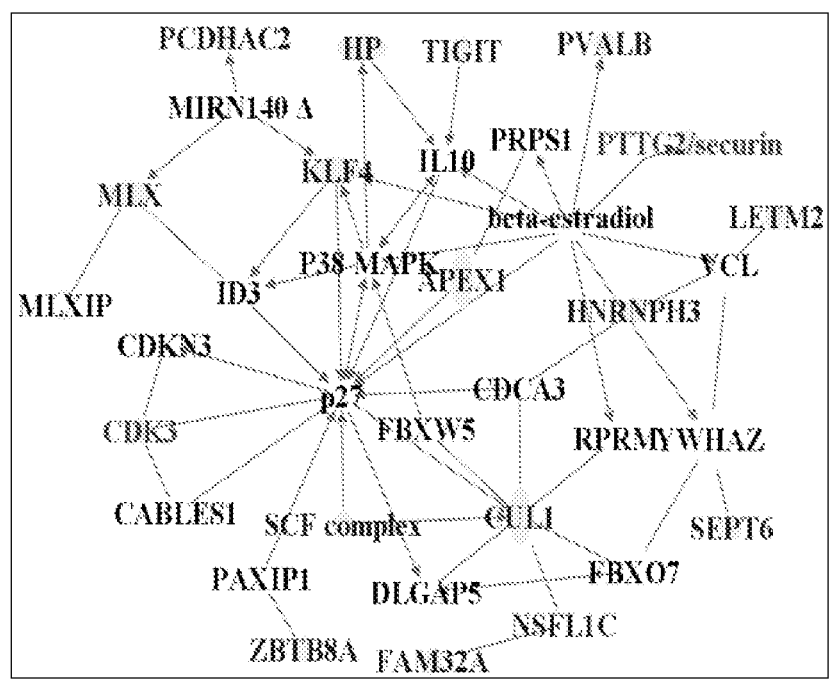
FIG. 11 shows FAT10 targets that mapped onto a the known interaction network for cell cycle regulation.
Figure 12:
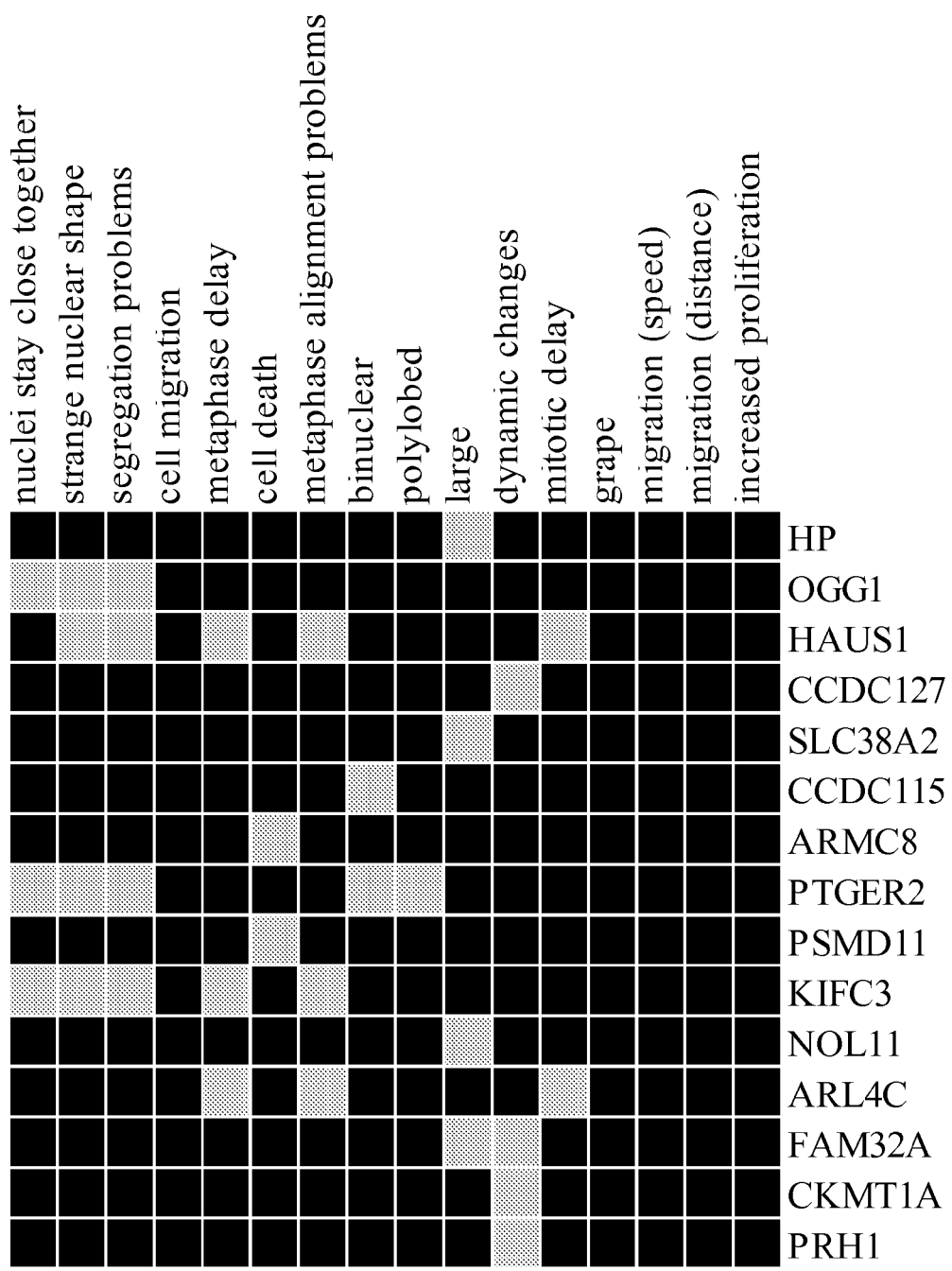
FIG. 12 shows a subset of proteins that are differentially modified by FAT10 described to have either a mitotic or death phenotype by RNA interference as reported in the "mitocheck" database.

Among the proteins that showed a change in FAT10 signal intensity were those that mapped onto a known interaction network related to cell cycle regulation (e.g. securin, cul1, septin 6 and cdk3; see FIG. 11), indicating that the FAT10 pathway is important for mitosis. Indeed, when this list of FAT10 changes were compared to a database of the phenotypic outcomes of a genome-wide RNA interference screen, it was revealed that 8 of the candidates have a mitotic phenotype (delay) upon knockdown and 2 additional genes to have a 'death phenotype' (FIG. 12).

Figure 13:
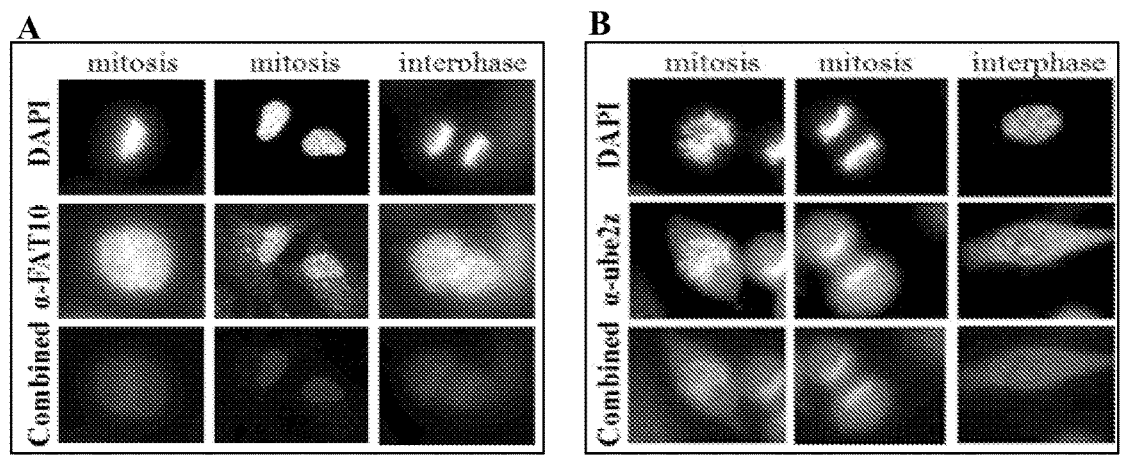
FIG. 13 shows the cellular localization of Ube2Z and FAT10 in interphase and mitotic cells. Imunofluorescence using either anti-Ube2Z and anti-FAT10 antibodies was done in order to detect their signal in the cell both in mitosis and interphase. A representative cell of more than 30 cells is given.
Figure 14:
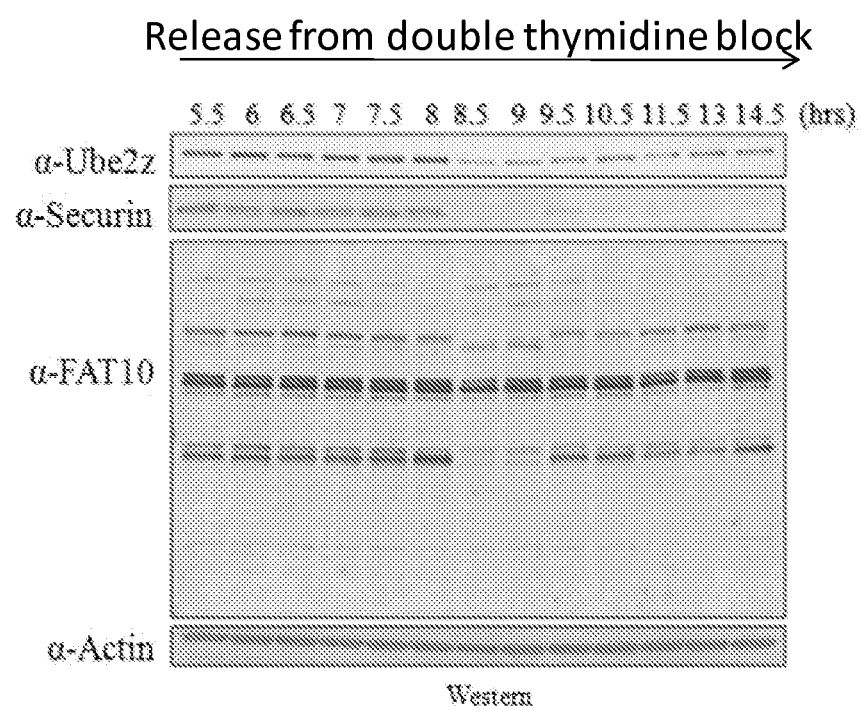
FIG. 14 shows that inhibition of the FAT10 pathway using RNA interference leads to mitotic arrest. HeLa cells were synchronized using double-thymidine block and released into fresh medium for 15 hours to follow cell cycle progression. Aliquots were taken for Western blot analysis of Ube2z, FAT10, Securin and Actin protein levels at the indicated time points. In additions, samples were taken at the same time for FACS analysis in order to follow cell cycle progression after synchronization.
Figure 15:
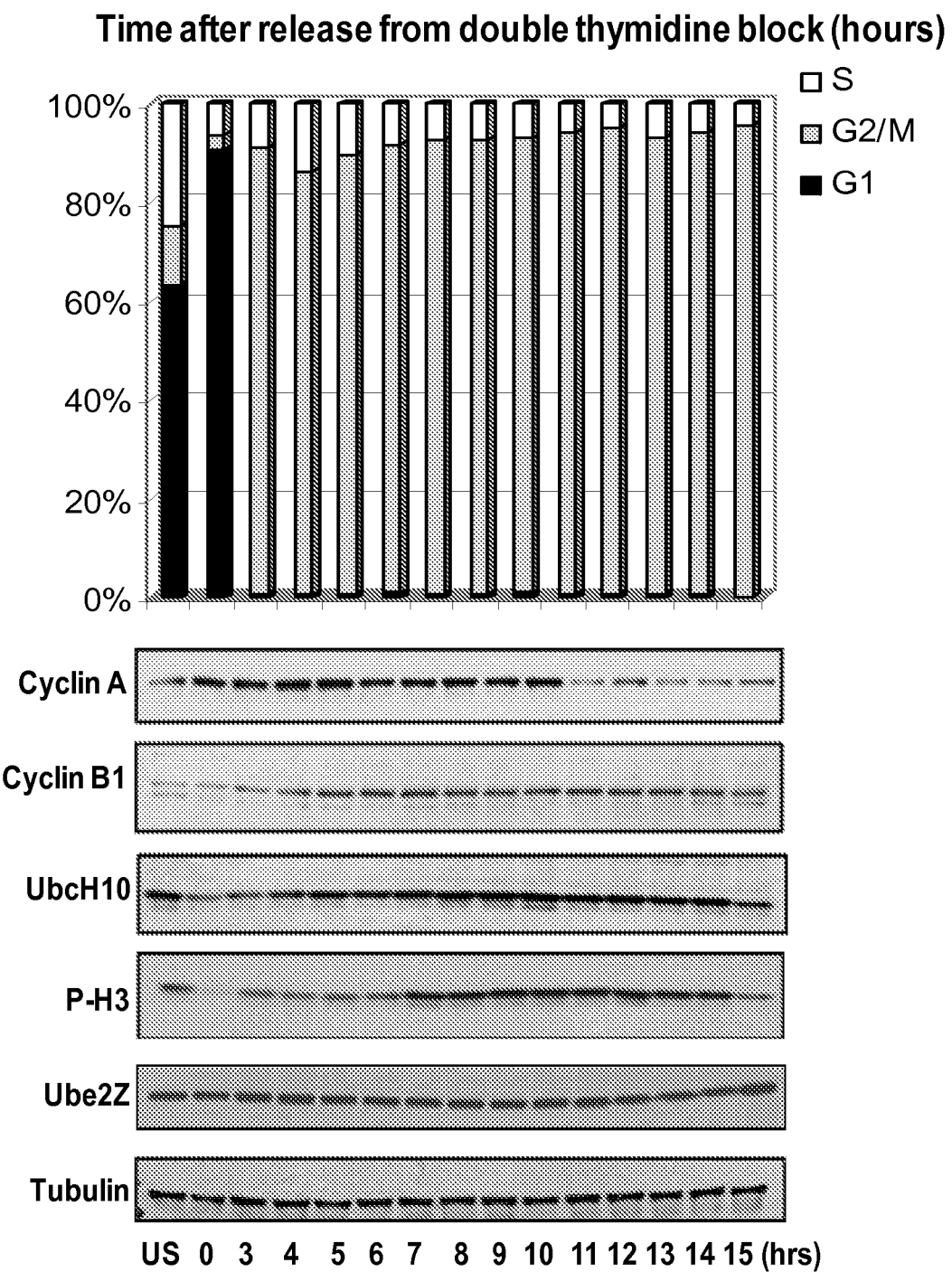
FIG. 15 shows that Ube2Z is stabilized in cells arrested with nocodazole. HeLa cells were synchronized by double thymidine block and released into medium containing nocodazole. Samples were aliquoted at the indicated time points and analyzed using propidiume iodide staining by FACS in order to determined cell cycle stage. In addition, samples were collected in the same time points for protein analysis of the indicated proteins using SDS-PAGE and western blot.

The only known E2-conjugation enzyme for the FAT10 pathway is Ube2z, a protein that is highly conserved in vertebrates and is expressed at high levels in various human cancer cell lines from the NCI-60 collection. Using immunofluorescence, it was determined that Ube2z is ubiquitously expressed both in interphase and mitosis in HeLa cells (FIG. 13). To measure levels of Ube2z in mitosis, cells were synchronized using double-thymidine block and released them into fresh media. Ube2z levels were high during G2/M and dropped precipitously in mitosis with similar timing to that of securin degradation (FIG. 14). When the cells were released from the thymidine block into nocodazole, Ube2z was completely stable even 15 hours after the release (FIG. 15). The timing of the degradation of Ube2z indicates that it may be required for the mitotic checkpoint and that its degradation may be regulated in an APC dependent manner.

To determine if Ube2z is an APC substrate, the ability of the specific APC inhibitory protein, Emi1, to inhibit Ube2z degradation in mitotic extracts was tested. In the absence of Emi1, Ube2z levels dropped gradually within 90 minutes (80% reduction). In the presence of Emi1 the degradation of Ube2z is completely blocked, indicating that Ube2z levels are regulated by APC.

Figure 17:
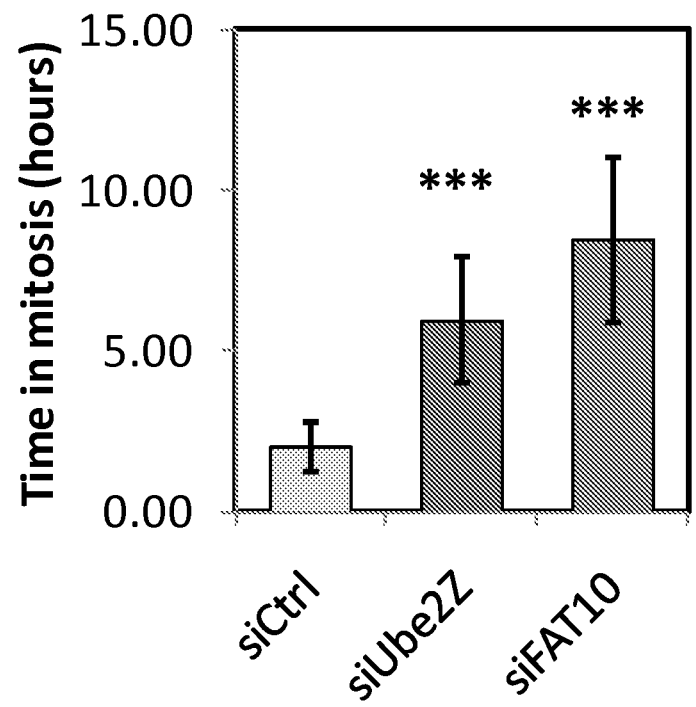
FIG. 17 shows that inhibition of the FAT10 pathway using RNA interference leads to mitotic arrest. The duration of mitosis was quantified from time lapse movies. Celts treated with siRNA for Ube2z or FAT10 spent a significantly longer time in mitosis (p<0.05) when compared to cells treated with control siRNA. Error bars depict mean and standard deviation.
Figure 18A:
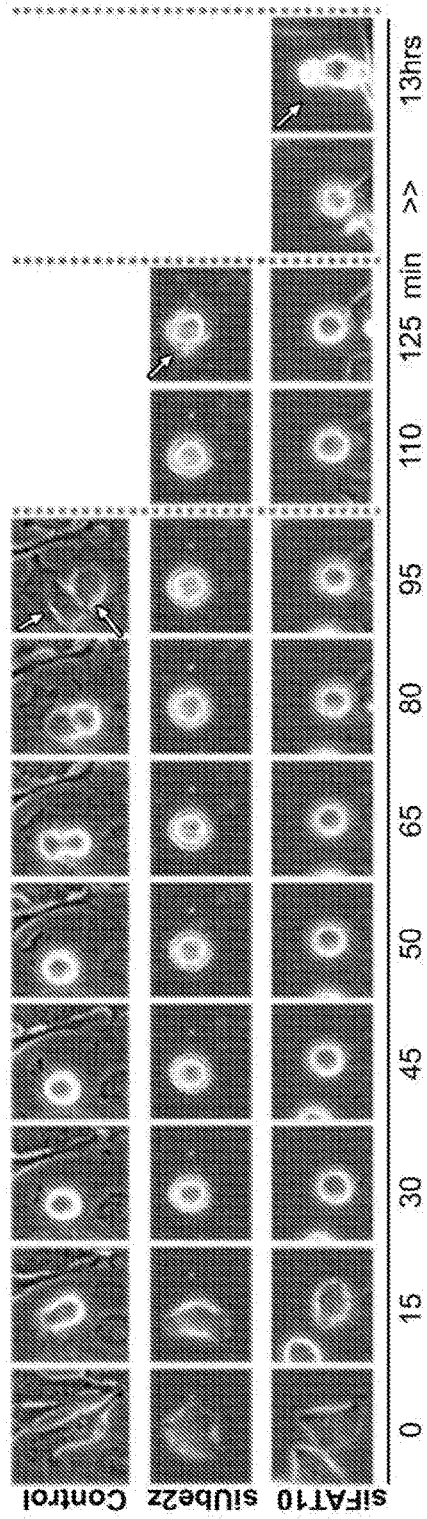
FIG. 18 shows that inhibition of the FAT10 pathway using RNA interference leads to mitotic arrest and cell death. (A) A representative cell (n>30 per condition) undergoing mitosis for each of the different condition (siFAT10, siUbe2z and siControl) is presented. (B) Quantitation of the percentage of cells in interphase (left), mitosis (middle) and percentage of dead cells (right) in each of the conditions during the course of the experiment.
Figure 18B:
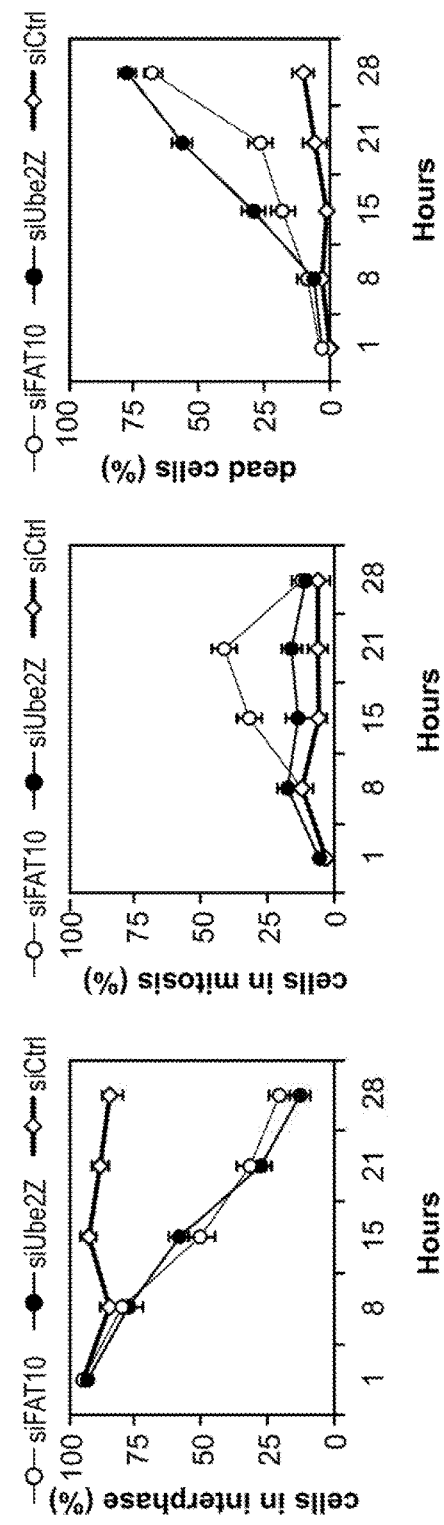

To look at the regulatory role of FAT10 in mitosis, the effects of inhibiting FAT10ylation via either a knockdown of FAT10, or by knockdown of its E2-conjugating enzyme, Ube2z were examined. HeLa cells were transfected with either siRNA against FAT10 or Ube2z, or with control siRNA and allowed the cells to grow for 72 hours. In both knockdowns but not in the control there was a substantial increase in the duration of mitosis, eventually leading to cell death (FIG. 16). When the average duration in mitosis was quantified (FIG. 17), it was found that cells stayed in mitosis at least twice as long, on average than controls (5.93±1.96 and 8.48±2.58 hours for Ube2z and FAT10, respectively), when compared to cells transfected with control siRNA (2±0.8 hours). Thus, both the inhibition of FAT10 and the inhibition of Ube2z extended mitotic arrest triggered cell death (FIG. 18).

Example 6

Loss of FAT10 Function Inhibits Cancer Progression

The role of FAT10 in tumor development was investigated using a mouse tumor model for subcutaneous melanoma. The subcutaneous model is widely used for the evaluation of therapy in many tumor models, including B16 melanoma. C57BL/6 wild-type (wt; n=7) mice or FAT10 knockout (KO; n=8) mice (C57BL/6 background) were injected subcutaneously with B16 melaoma tumor cells. A dose of $1 \times 10^5$ cells/mouse, which is 1.5 to 2 times the minimal tumorigenic dose in normal C57BL/6 mice, was used for both control and KO mice. Upon subcutaneous injection, B16 form a palpable tumor in 5 to 10 days and grew to a 1 cm tumor in 14 to 21 days. Tumor growth was manually inspected and measured every other day and recorded accordingly.

Figure 21:
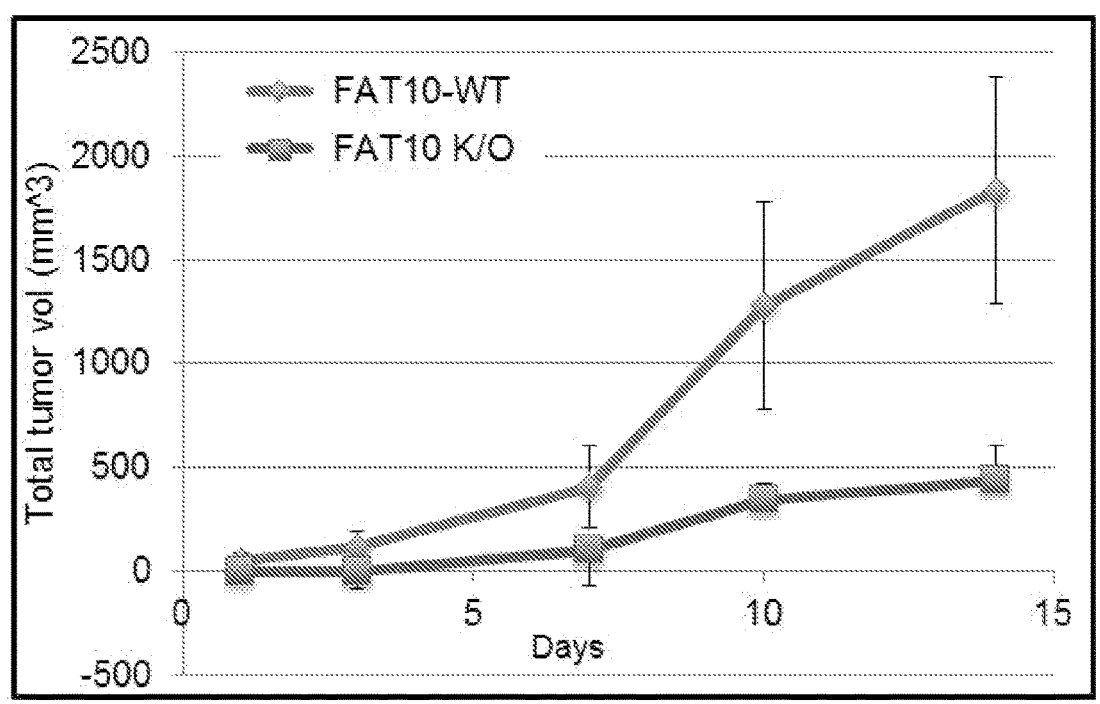
FIG. 21 shows tumor growth rate of B16 melanoma tumor cells in FAT10 KO (Squares) and FAT10 wt (Diamonds) mice. 1×10⁵ cells were injected into C57BL/6 mice and tumor volume (mm³) was assessed every other day.

As depicted in FIG. 21, deficiency of FAT10 inhibited the ability of tumors to grow in mice and resulted in a significantly slower rate of tumor growth in the KO mice when compared to the wt. Since the tumor cells that were injected to both the control and KO mice were identical, the difference in tumor growth observed cannot be the result of a difference in the tumor cells themselves, but rather reflect the ability of the environment to support tumor cell growth.

Figure 22:
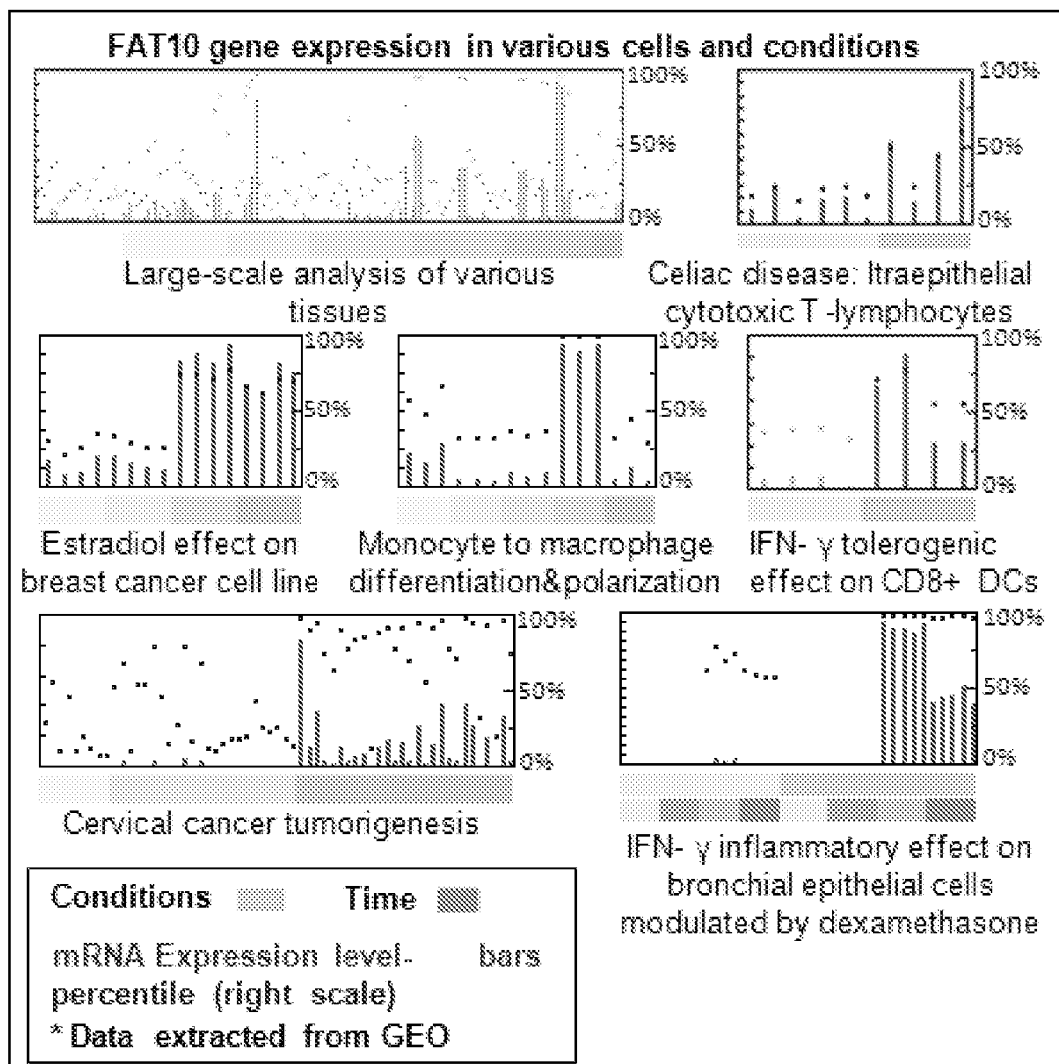
FIG. 22 shows FAT10 gene expression in immune and cancer cells under the stated conditions. Percentile refers to the relative level of expression of FAT10 versus the most highly expressed genes in that cell type and condition.

Inhibition of tumor growth in FAT10 deficient mice may be the result of difference in immune function. Analysis of cDNA microarray data suggested that FAT10 is expressed in several types of immune cells and conditions (FIG. 22). Indeed, increased FAT10 mRNA levels were detected by qPCR upon activation of NK, dendritic cells and macrophages that were isolated from wild-type C57BL/6 mice and activated in vitro.

SEQUENCE LISTING (282 sequences)

SEQ ID NO: 1 - DNA, 1006 bp, Homo sapiens
gattgcttgaggagagaagtatgtgatcagaaagcattctttgtctattaactcctgcccagcaaaagtgaaagaaaattcatgggagcatgcaagaacaaagagcacagcaaagctggacaaacacagcaatccaggcaggggatttccaactcaactctggtatataagctgcatgcaaagtcctttttctgtctctggtttctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatgttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagccaaaaaaaaaaaaaaaaa

SEQ ID NO: 2 - protein, 165 aa, Homo sapiens
MAPNASCLCVHVRSEEWDLMTFDANPYDSVKKIKEHVRSKTKVPVQDQVLLLGSKILKPRRSLSSYGIDKEKTIHLTLKVVKPSDEELPLFLVESGDEAKRHLLQVRRSSSVAQVKAMIETKTGIIPETQIVTCNGKRLEDGKMMADYGIRKGNLLFLACYCIGG

SEQ ID NO: 3 - DNA, 1500 bp, Homo sapiens
ccggcctccctgacatgcagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtgaaaaaaaaaaaaaaaaaaaaaaaaaaaaaaaaaaaaaaaaaaaaaaaaaaaaaaaa

SEQ ID NO: 4 - DNA, 1934 bp, Homo sapiens
ggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataaccttcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaaaaaaaaaaaaa

SEQ ID NO: 5 - DNA, 2984 bp, Homo sapiens
ggaaattcaaacgtgtttgcggaaaggagtttgggttccatcttttcatttccccagcgcagctttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaatctaagagaaagtcagagtgtattaaccagaatcctgctgcatcttcaaatcactggcagattccggagttagcccgaaaagttaatacagagcagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccattttaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccctatgttcaaattcaaactcatccagttaaccaaatggccaagggaaccactgaagaaatgaaatatgttctgggccaacttgttggtctgaattctcctaactccattttgaaagctgctaaaactttatatgaacactatagtggtggtgaaagtcataattcttcatcctccaagacttttgaaaaaaaaaggggaaaaaaatgatttgcagttattcgtaatgtcaaataccacctataaaatatattggactgttatactcttgaatccctgtggaaatctacatttgaagacaacatcactctgaagtgttatcagcaaaaaaaattcagtagattatctttaaaagaaaactgtaaaaatagcaaccacttatggtactgtatatattgtagacttgttttctctgttttatgctcttgtgtaatctacttgacatcattttactcttggaatagtgggtggatagcaagtatattctaaaaaactttgtaaataaagttttgtggctaaaatgacactaaaaaaaaaaaaaaaaaa

SEQ ID NO: 6 - DNA, 1341 bp, Homo sapiens
ctctaaggcggccacacgggcatggccgtggggctggcgactggtgtttagcaactccgaccacctgcctgctgaggggctagagccctcagcccagaccctgtgcccccggccgggctctcatgcgtggaatggtgctgtgccccttgccagcaggccaggctcaccatggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggaaattagttacttccagttccctggagagctcctgatgaggatgctgaagatgatgatcctgccactggtggtctccagcttgatgtccggacttgcctccctggatgccaagacctctagccgcctgggcgtcctcaccgtggcgtactacctgtggaccaccttcatggctgtcatcgtgggcatcttcatggtctccatcatccacccaggcagcgcggcccagaaggagaccacggagcagagtgggaagcccatcatgagctcagccgatgccctgttggacctcatccggcagaaagaagaaagttggaggaacggaccaaagggtcctggctgaatgggcacctccttaagagttttccaggaatcaccacccaacgacttccactcacctctcgatggccaccccattagcaagagaatcagagcttgatggcaggtcccatttggtccccacaacataataggacttctattaaggaaggacgggagaatggagactgcataggcaactagctgtctctgccaaggcccacatttaaaatgattgtaattgtaaaggaagttgtaaagaaatgtctatataggtataagttccatttggcttcttacgagcttccaaatgttctccgtgtgtgtaaactgagtcttgaaagaggggaagagggttaccgaggacaagagtgagtgggaggcgacccaggtggaggcagtgtgagtgtggggcggcaggttggaggaagagcaggcatgcaacggaagcctcttaccagatgctcacctcagagttggcatttctcacaagacacactcctagaaggggactgtgaagacaaagatacaaatgcttttagagaaaggttgctgccaggaccatgtgagggtgcccatctcaccaaacctcccacattgtgcactgtcatttgaaaaatactttgtcagtttgacaggtggaaatatcttgaatttgttgatgaaactaaacattttaaaaagcaaaaaaaaaaaaaaaaaaaaaaaaaaaaaaaaaaaa

SEQ ID NO: 7 - DNA, 1111 bp, Homo sapiens
gcgcttagtctgcacgccgaggtccgcgctgtgtcccgtgttttctgcgtgagaggaaaagatgctagaaccacaggagaatggcgtgattgacctaccagattatgagcatgtagaagatgaaacttttcctcctttcccacctccagcctctccagagagacaagatggtgaaggaactgagcctgatgaagagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgagagaaataaacaactggccttggaaagaaggcaggcaaagctgctgagtaatagtcagaccctaggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgtttaaaaaaaaaaaaaaaaaaaaaaaa

SEQ ID NO: 8 - DNA, 2415 bp, Homo sapiens
gcagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataaaaaaaaaaaaaaaaaaa

SEQ ID NO: 9 - DNA, 2172 bp, Homo sapiens
ccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttaaaaaaaaaaaaaaaaaaaaaaaa

SEQ ID NO: 10 - DNA, 1656 bp, Homo sapiens
agcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaacagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggatgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtaaaaaaaaaaaaaaaaaaaaaaaaaaaaaaaaaaaaaaaa

SEQ ID NO: 11 - DNA, 847 bp, Homo sapiens
cctcgtgccgattcggcacgaggcccgggcacgctggctctggtccaccttctccaatccctgcctgctgggagaggacgatctcttgagaaaggaaagacttctgtgctcccgagaacttcctatcaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattgggtcaggagatcgagaccatcctggccaacatagtgaaatcccatctctactaaaaatacaaaaattagctgagcatggtggcatgtgcctgtaatctcagctacttgggagcctgaggcaggagaatcacttgaaccagggagtcagaggttgcagtgagccgagattgtgccgttgcactccagcctggtgacagagtgaaactcagtctgaaaaaataaaaaaaaataaaaaaatatttaaaaaaaaaaaaaaaaaaaaaaaa

SEQ ID NO: 12 - DNA, 2801 bp, Homo sapiens
cggaagtggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggaggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcaggaaaaaaaaaaaaaaaaaaaaaaaaaaaaaaaaaaaaaaaaa

SEQ ID NO: 13 - DNA, 1867 bp, Homo sapiens
ggcgcgcaagatctccccgcgcgagagcggcccttgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaaccgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggctggcggggccacgcccggggccaccctccccaagtccccatctcagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcagggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaaaaaaaaaa

SEQ ID NO: 14 - DNA, 1735 bp, Homo sapiens
aaaacctacctggagaccaaaggggcagccttgagccagaccacagagtttcttcctttctatgcccttccttttgttcccaaccctatggtgcacccctcatttaaagaactcttccaggattcctggactccagagttaaagttgaagttggaaaagtttctagctttaatatctaaagccagcaacacgccaaagcttttaacaatatataaggagaatggacaaagtaacaaagaaatcttgcagcagctccaccagcagctggttgaagctgaacgtaggtcagtgacatacctcaaacggtacaataagatccaggccgactaccacaatctcattggagtcacagcagagctggtggattctctagaggccacagtcagcggcaagatgatcacccctgagtacctccagagcgtctgtgtccgcctgttcagtaaccagatgcggcagagcctggcgcatagtgtggacttcacgaggcctgggacggcatccaccatgttacgagcctccttggcacccgtgaaattgaaggatgtcccattactgccctccttggattatgagaaactgaagaaggatttgattttggggagtgaccgcttgaaagccttcttgttgcaggctctgcgctggcgcttgaccacatcccatcctggagagcagagggagaccgttctgcaagcctacatcagcaatgacctcttggactgttatagccacaaccagaggagtgtgcttcagttgctgcactccacgagcgacgtggtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtggcaggcctcgtgctcaaagtcctttcggatcttcttggccatgaaaaccatgagatacagccgtatgtgaatggagctctgtacagcatcctttctgttccatccattcgtgaggaagcaagagcaatgggaatggaagacatcctacgctgcttcatcaaagaaggcaatgctgaaatgatccgccagatagaattcatcatcaagcagctaaattccgaagagctaccagatggtgttcttgaatctgatgatgatgaagatgaagatgatgaagaggaccatgacatcatggaagccgatctggacaaagacgaactgatccagccccagcttggagaactctcaggagagaagcttctgaccacagagtacctggggatcatgaccaacacggggaagacaaggcggaaggggctggctaatgtgcagtggagcggggatgagcccctgcaaaggcccgtcacccccggcggccacagaaacgggtacccagtgtaagtcagggctaaaggaagcgggaattgactttcttaagctttgttttgattacagtgtaagatgtatgtatttttaaaattcaaaataaagcattcattttgaaaaaaaaaaaaaaaaaaaa

SEQ ID NO: 15 - DNA, 1862 bp, Homo sapiens
caacccggtccctgagagggcactgcgccctctccaccactgcgttccctcggctaagaatcccccgaaccccagccccgcgatcgcggcgcccaccgaggaggccgcccgggtggggcgcgggggtcgcgaagcccgcagccccggaccgcccagccgagacggagccggacccgccgcctcccgggtggatctttaactcaagactagcatgaagagttgccttctggcctgccctgagtctcctcaaataacaacaggcccttccaccgcagctatccgcacgggaggcctcgcgattgctcggaaccatcccacaggagttcagctgatattttctagtgtggggcgagagattttgtggagcgcatttaaggggtttttgttgtgactgctgccttgtatatatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcacagagcccctgatgctgttgttctttgagggcttaaggcctgatgaacgtaggcacgtgatgcgtaatagtcttcaatggtacacttaactagtctcttctgtgtaacagcaaaaaaaaaaaaaaaaaa

SEQ ID NO: 16 - DNA, 1685 bp, Homo sapiens
agaagaagaggggggctggaggccatggccgcacccggagaaaagatgccagcaaggccacagggggtgtgaggggacactcgagtgccgccaccagcagaggagctgcaggttggtcaccgtcctcgagtggaaacccgatggccaagccagagtcccgcaggttgaagcaagctgctctgcaaggtgaagccacacccagggcggcccaggaggccgccagccaggagcaggcccagcaagctctggaacggactccaggagatggactggccaccatggtggcaggcagtcagggaaaagcagaagcgtctgccacagatgctggcgatgagagcgccacttcctccatcgaagggggcgtgacagataagagtggcatttctatggatgactttacgcccccaggatctggggcgtgcaaatttatcggctcacttcattcgtacagtttctcctctaagcacacccgagaaaggccatctgtcccccgagagcccattgaccgcaagaggctgaagaaagatgtggaaccaagctgcagtgggagcagcctgggacccgacaagggcctggcccagagccctcccagctcatcacttaccgcgacaccgcagaagccttcccagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttatttttaaacaaaaaaaaaaaaaaaaaaaaaaaaaaaaaaaaaa

SEQ ID NO: 17 - DNA, 770 bp, Homo sapiens
gagattgttgatttgcctcttaagcaagagattcattgcagctcagcatggctcagaccagctcatacttcatgctgatctcctgcctgatgtttctgtctcagagccaaggccaagaggcccagacagagttgccccaggcccggatcagctgcccagaaggcaccaatgcctatcgctcctactgctactactttaatgaagaccgtgagacctgggttgatgcagatctctattgccagaacatgaattcgggcaacctggtgtctgtgctcacccaggccgagggtgcctttgtggcctcactgattaaggagagtggcactgatgacttcaatgtctggattggcctccatgaccccaaaaagaaccgccgctggcactggagcagtgggtccctggtctcctacaagtcctggggcattggagccccaagcagtgttaatcctggctactgtgtgagcctgacctcaagcacaggattccagaaatggaaggatgtgccttgtgaagacaagttctcctttgtctgcaagttcaaaaactagaggcagctggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccctaaataataaaaataaacatgtttccacgaaaaaaaaaaaaaaaaaaaaaaaaaaaaa

SEQ ID NO: 18 - DNA, 1393 bp, Homo sapiens
ggagcatcgcggctcaggctgcgggaaagcggtgcgcgtgcagcggggtgggtgccctggtccgcgggcgagctcgagcagccaaccccgggcgcgtcggggccatggacggcctgaggcagcgcgtggagcacttcctggagcaaaggaacctggtcaccgaagtgctgggggcgctggaggccaagaccggggtggagaagcggtatctggctgcaggagccgtcactctgctaagcctgtatctgctgttcggctacggagcgtctctgctgtgcaatctcatcggatttgtgtaccccgcatatgcctcaatcaaagctatcgagagcccaagcaaggacgacgacactgtgtggctcacctactgggtggtgtacgccctgtttgggctggccgagttcttcagcgatctactcctgtcctggttccctttctactacgtgggcaagtgcgccttcctgttgttctgcatggctcccaggccctggaacggggctctcatgctgtatcagcgcgtcgtgcgtccgctgttcctaaggcaccacggggccgtagacagaatcatgaacgacctcagcgggcgagccctggacgcggcggccggaataaccaggaacgtcaagccaagccagaccccgcagccgaaggacaagtgaagcagccccctgagcctcacaaggacctcctggctggtgaggagggggccgcgccaggctcccaggcctccacagagtcttcagcgcatcccccaacagcagcccctgccagtccctcgggtccaggcaaggccctgggggtctccttaaatgccacctcgggcaagtcccagtcccagtcctcggccacccccagctctggatcccagggccagctgccctctggctctggctgtggctcccgcctgtccggcagggcccagggccagcgtcgggcacagggcagctcccactggtctcggcaacacacccagccgcctggtacttcctccagcccctcccagtcagccctcccgtcctcggggcccctgcagccacccaacgtcacctccagcccggtctcacccatggtccagtctcccagcagcagcaacatccccacgcagccccccagcaagtcctctggcaagccggaggacgcagcccccaagaccagcggacagcgccagaaggaatcgtcgaaacagcctgccagcagcgcctcagtgcccgagctggtcccctgccattccgggacctctctggagtacacttcggagtccaccaccgagatcacctgcagctggccacaccacaggcccccgtgcctgcagcactactggtgcctgaaacacctggcctgctaggaggctccaataaagctaacccggaccaaaaaaaaaaaaaaaaaaaaa

SEQ ID NO: 19 - DNA, 600 bp, Homo sapiens
ctttcggcgggcctcgcggatggcggcgcagggcgtagggcctgggccggggtcggcggcgcccccggggctggaggcggcccggcagaagctggcgctgcggcgcaagaaggtgctgagcaccgaggagatggagctgtacgagctggctcaggcggcgggcggcggtatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagagacaaaggcagcgctgccctcgggggagtattggccctggcggaacgcagcaaccacgagggatccagccagaggatgccacgccagcccagcgctaccaggctgcccaaggggggcgggcctgggaagagccctacgcagggcagcacctaggatggggcagagacttgtcacatctttgtccccagcaaaggctacatgttacctccttcagttgataataaacctttctgagatgcaaaaaaaaaaaaaaaaaa

SEQ ID NO: 20 - DNA, 1317 bp, Homo sapiens
gggagactgacgtgtgaactgcatcgcgggaggcgcatggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcgtgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaatataaccaaccttataaagactaaaattcatgagtagaacaggaaaatcatcctgactcatgtgttgtgttctttatttttaattttcaaagaggctcttgtatagcagtttttgtctattttaacattgtagtcatttgtactttgatatcagtattttcttaacctttgtgactgtttcaatattacccccgtgaaagcttttcttaatgtaactttgagtacattttaattgccttctatttttaaaactcaaaatcattagttgggctttactgttcttgctattgtatggcatatacatctgcctggatatatttctactcttgaccaaagttttgtaaagaacaatataagatttcgggtaggggtatggggagggaagatattttattgagaactacttaacaaaagatttatctgtaagcttgaactcaggagtacagttttagctatctagactctaacagcttttgctttaaaattattaaagtgtttcttaatgaaaaagaaaagatcttgctaaagttaaaataaggaacatttcaccttttaaatatttaattcttatgtggacttatttccagaaaactttggtgataattcttgagacaaaaggtggttaagtagcattattatgtaatgcttatataccatagagtttttaatagaagagaaatccatttcctccgagggtcactattaacaatgtacttccttaaatttagtttaatgattgtaatgggtgctgcatttgcacattgcattaagttatgatgagacgaattgttgttaaaaattatagcaaaaagaaatgtaaacttggttaaaatcctttcactctttgtattgttttttttaaggtttttattccttaaatgtaaaatgactacctaattttttgatgtaaatacattaaattcaaagagaaaaaaaaccaaaaaaaaaaaaaaaaaaaaaaaaaaa

SEQ ID NO: 21 - DNA, 1055 bp, Homo sapiens
agtgcggacattgtcagctgcgtttccgcggtcgcggttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaactggtaaaaaaaaaaaaaaaaaaaaaaaaaaaaaaaaaaaaaaaaaaaaaaaaaaaaccaaaaaaaaaaaaaaaaaaaaaaaa

SEQ ID NO: 22 - DNA, 1969 bp, Homo sapiens
ggccgcgagatggggaagatggcagcggccgtgggctctgtggcgactctggcgactgagcccggggaggacgcctttcggaaacttttccgcttctaccgtcagagccggcccgggaccgcagacctggaaggggtcatcgacttctcggcggcccacgcagcccgtggcaagggtcctggtgcccaaaaggtgatcaaatctcagctaaatgtgtcttctgtcagtgagcagaatgcatatagagcaggtcttcagcccgtcagcaagtggcaagcctatggactcaaaggctatcctgggtttatttttatcccaaaccccttcctcccaggttaccagtggcactgggtgaaacagtgccttaagttatattcccagaaacctaatgtatgtaacctggacaaacacatgtctaaagaagagacccaagatctgtgggaacagagcaaagagttcctgaggtataaagaagcgactaaacggagaccccgaagtttactggagaaactgcgttgggtgaccgtaggctaccattataactgggacagtaagaaatactcagcagatcattacacacctttcccttctgacctgggtttcctctcagagcaagtagccgctgcctgtggatttgaggatttccgagctgaagcagggatcctgaattactaccgcctggactccacactgggaatccacgtagacagatctgagctagatcactccaaacccttgctgtcattcagctttggacagtccgccatctttctcctgggtggtcttcaaagggatgaggcccccacggccatgtttatgcacagtggtgacatcatgataatgtcgggtttcagccgcctcttgaaccacgcagtccctcgtgtccttccaaatccagaaggggaaggcctgcctcactgcctagaggcacctctccctgctgtcctcccgagagattcaatggtagagccttgttctatggaggactggcaggtgtgtgccagctacttgaagaccgctcgtgttaacatgactgtccgacaggtcctggccacagaccagaatttccctctagaacccatcgaggatgaaaaaagagacatcagtacagaaggtttctgccatctggatgaccagaatagcgaagtaaaacgggccaggataaaccctcacagctgagacttggagatcccatcctttttactcaggcacctgcttaccgtaaatgatcatgttattgtgtattgccgtggacttcagcacccagacaagccaaaaacagagacagggaagaactcattgttgatcacactgttgccttggaacccacgcagaagtaaactcatccactttgctcagagaagtgtttgacatggtctgttcctagttacatgttggctgtaatgtatgttgagaagtcagtccaaggaggtatgttcttccacaacagccttctcagcctctgctatttcctttgaggaaggtagaagtgagtttccatgtttgcagagtatttaaatacctcagattttattaatgagaaatacagtacccctccctccactccatctggtaatttatggtaaaattgtggttctgtgaaccagctattagtctcatcttcttaactccctcaggcatcatcaaattctttgatcttctcttccacctctctggctctcatggaagaatcctttacacatgaaaacaatggaactggaaaatcttgtcttttagaaaagaaattaatcacaactatctctcttgcctaaaagataaatataggtaaacccaaggaaaggggaatttagtttctctacatgtcatttcggtctccaaactccctgttggctttttaatgcaattttaattgttggaataaaaaagtcccaagggtgttttgttactgttttctccatgaataaactcacttgattttaaattaaaaaaaaaaaaaaaaaaaaaaaaa

SEQ ID NO: 23 - DNA, 723 bp, Homo sapiens
aaatcaacacattgagtcaagaaaaatgaaacacagaaacactctaaataaaagaagataagtcttcagaaaccaaccctaatgaaatgaagatatgtgattaacctgacaggaaattaaaaagagcaaccataaagagtctcatgggagcaatgcatgaacaaactgagaattttcataaagaaataaaagataacaaaaagtataaagttgaagaatacaataactggactcaaaaatttaatgtgtccaacagaagaatcgatgaagcagaagaaagggctatcaaacttgtagataggccattggaaatcatgtaatgtgaggagaaaaaagaaaaaagattgaagatagtttaagagacttttgagacatcctcaaaggggaataatttatacattaccagatggagaagatagagggaaaaggacagaaaacatatttgaagaaataatgtcagaaaacctcataattctggcaaggaaatagaaatttagatctaagaatctcgaacatcaggtatgatgaatccaaggagactcacaccaaaccatattgtaattaaataaaggttaaagacaatcttcagagcagcaagggaatagtctcttcttacatacaaaatgatccacggaagactgtcagcagacttcaccagaaaactttcacgccagaaggcagtcgtgatatatacaaaaaaaaaaaaaaaaaaagaaaaaaaaa

SEQ ID NO: 24 - DNA, 2507 bp, Homo sapiens
gtcgagtgtttctcagcaagagcccgtgtcccgctaggctcggcgccctcgcgcccatagccccggcggcggcacgaccagaggcggccaggggagcgcgccgccccgctcggccctccagtcccgctccgccgcctccctcccgcacagcagccgccagcgcggcctcctgcaccatgtcggtggccggcctcaagaagcagttccataaagccactcagaaagtgagtgagaaggttggaggagctgaaggaaccaagctagatgatgacttcaaagagatggaaaggaaagtggatgtcaccagcagggctgtgatggaaataatgactaaaacaattgaataccttcaacccaatccagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggcccagcacttggtgaggtcggggaggccatgcgggaactgtcggaggtcaaagactctttggacatagaagtgaagcagaacttcattgaccctcttcagaatcttcatgacaaagatcttagggaaattcaacatcatctaaagaagttggagggtcgacgcctggattttgattataagaaggaacgacaaggcaagattccggatgaagagcttcgtcaagctctagagaaatttgatgagtctaaggaaattgctgagtcaagcatgttcaatctcttggagatggatattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccactaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacacatcccaagtgcaggccgcagtggtccacgtcatccagccccaccaagtgactttggttgacttgtgggctcccacaggagtcatggtgatggatgatatcctcttagcctggtgggcatggcatgtgctttttaaaacatcatctgagaccagccagtagtcacagaactgctgtttacacagttctcaggaggctgtggtttcttagaatatgaccatgagccatttcacagaaaaaccatcccaccgaagatattgtctatcaccccaggggccatctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatttgtctcttaatgcatccatagaaaagtgttaattgtgggttcaaagcattctctgcaaataggcatctcagctcctcacacttatggctatttctgacgtatagccagttttcttccctccttgctattaaagccagagcggtaattccaaattatttttcagtaagacagttaatcagcattattgtgagagggactgaaaagaaattctccattatgaggaattgggaagaaatctggtatccaagcttaaatttcttgctatacagaaactatgtatgtatttaggctatttctgaagggcacagggaagggggaacaaatatcttcacttcagttttatttgtgaattacatgtttcatgaatccatttggcacagagacacaaggaagaaaacactagtaaccatctttccactagttcatagactgagaaacagtaaatacctttcctttccacttttaccctgtgttctttgaacatcatttgtgcagattctgccctcaatgaggaccaaataaagatgatttttgtgcttagcagtttaaggtatatggctgcatatgcaaaactctttcccaattcagtcgctacttttacttctgccctttctatccatcgtcttcattttgtgtgtacagtgctgtgtgtaagcttatcagtgtgttttttatttgtatcagtcatgaaagtcctgttaggtatccagagttctatttatctagctgtacagactctttcagaggtttaacgtgctgcttccgatgtgccacctgcagtagtggatcatgtggagtgaaaggcaaatcttactgcttaatgtataaactctcaccacaggaagcatcgctgtttccaataaatattgctgaagacagaaaaaaaaaaaaaaaa

SEQ ID NO: 25 - DNA, 1430 bp, Homo sapiens
aggcagctgtccccagcggccagtgtcccccatgccggatctctaggatctggaaggccgctgctgccaggaacaagaagtcagagagggccaggctgagcaggagcagcgccagacgcgtgccagctccatgccgggcctgggagccggccagccacgccatcaacccattggctggcagcccaaggagcagcagggccaccaggaagaccgtgtcccagccaccttggggtcccaccgacatcgtcctgactccctgcacgacgctgctcagaggacatacgggcccctgctcaatcgagtcttcgggaaggccaacatgagcaggggatgaaggaggaaggatgacagagccgtggctggccctggggacatcctggactctccccctgcaggaccgcgaactgggccccgaggagctagacgagcttcaggccgccttcgaggagtttgacactgaccgtgacggctacatcagccaccgggagctgggtgactgcatgcggaccctgggctacatgcccaccgagatggagctcctggaggtctcgcagcacatcaagatgcgcatgggcggccgtgtggactttgaggagtttgtagaactgataggcccaaagctgagggaggagacggcgcacatgctgggggtgcgagagctgcgcatcgccttccgagagtttgacagggacagggatggacgaattacggtggcggagctgcgggaggcggtaccggctctgctcggggagccgctggcgggtcctgagctggacgagatgctccgagaagtggacctcaatggggatggcaccgtagactttgacgagtttgtgatgatgctctcccgccactgaggctccaggagggaatatctgttgcccctgcggccccagacaccagccagacccaggctgcaggcctcccccaggagcctccaggatggagatggagacccagcagcccccagactacttctatccctgaaaacacctggcctcaatgttggcttgttatgttacctgcccaccctcatccttacctcctcctactcaagctgcctggagaagacctgctctcagctgcccaccgttcctcagtgtgagcaagatttgggtctctccagacctctgggaggtagggagttccctggcactggcagcattcagtggggaccccccagtggcatgatgaatggagaggatggctggaccccttccactacttatgtttataattttttttttttttaatgaacttgagccgggtgcagtggctcacacctgtaagcccagctgtcagggggcagaagcgggaggatagcttgagcccaggagtgcaagacctgcctgggcaatatactgagaccccattctccacaaaaaggaaaaataaaagacaaaaaaacaaacaaaaaaaaaaaaaaaaaa

SEQ ID NO: 26 - DNA, 1553 bp, Homo sapiens
cgctcctgagagaagggcgcgcgcggcacaggggccttccttgcacctcggagcaaagcagctcggatagcgccacacgtctgcgccctgcgtgggaagggcagggctgacagcacttcctccccggggcagagacctggagcccgggtgcggcagtctgcaccgcgcgtcgctttcccggccggagcctcgccgccttcccgcgccccgcagcgccccgcagagcagtcgagatgggtgagtcaagtgaagacatagaccaaatgttcagcactttgctgggagagatggatcttctgactcagagtttaggagttgacactctccctcctcctgaccctaatccacccagagctgaatttaactacagtgtggggtttaaagatttaaatgagtccttaaatgcactggaagaccaagatttagatgctctcatggcagatctggtagcagacataagtgaggctgagcagaggacaatccaggcacagaaagagtccttgcagaatcaacatcattcagcatctctacaagcatcaattttcagtggtgcagcctctcttggttatggaacaaatgttgctgccactggtatcagccaatatgaggatgacttaccacctccaccagccgatcctgtgttagaccttccactgccaccaccacctcctgaacctctctctcaggtaagtatgtgggaccagagatggcaggaccatcaacctctgctacctatcactgatgttccttgaagtgatcattacattcctaagttggtacatccaaagatctgagatactaaaaaacaaagatacagagcacgctcattgcaaagctagaaccctccgtaagcaagccacatgggtgtgtatcaagaatgtattagggccatattcaggatttactgtagtttgcttaaaaaatatttgtatgcaaaaactatttgataaaactcaatcttttgggggaaatgttttattaacatcatattgaaatgtggaactgattatatatttccatgtccctgttcttagctcagtacatagagaatagaaggcattcattatacattttctgagtagagtgaaattgaattttgttgaacttggcagccctgttcagtaggacaggtacatccaagtatcacttgtaatgtcatagttggggagggtgttacaaagcaggcagatgatgggtgcttgatattgataaatttctgaatattgaaaaacagacaactggaaagtttaaatgatcattatttgggatgttaactcatagtatgtctctcataaaagtaaaaagagcacttttaaggattttctttttagagtaagccaaatattttagaggagagtccagttcaatttcctgtggcttctacaatggtcacactgtgtcatgatgtttggtactcacaaataagaccctagggaccccgaaaggtcatacaatgccttttgaatgaacaaatattgaatataaatcaaatattaaattatactctatcacaaaaaaaaaaaaaaaaaaaaaaaaaaaaaaaaaaaaaaaaa

SEQ ID NO: 27 - DNA, 4696 bp, Homo sapiens
actagttctagatcgcgagcggccgcaccttgctctccctcgggctgctggttgctgactttggcgccatggtcaataacccacacctgagtgatgtccagtttcagacggacagcggggaggtgctttacgcccacaagttcgtgctttatgcccgatgcccgctcctcatccagtatgtgaacaatgaaggcttctccgctgtagaggacggggttctgacccagcgtgtcctgctgggtgacgtgagcaccgaggccgcccgcacgttcctgcactatctctacactgcggacactggccttcctcctggccttagctctgagctgagctccctggcccacaggtttggcgtgagtgagctcgttcacctgtgcgaacaggtgcctattgccactgactcagagggcaaaccatgggaggagaaggaagcagagaattgcgaaagcagggccgagaatttccaggaactcttgaggtcaatgtgggcagatgaagaggaggaagcggagactttgttgaaatccaaggaccacgaagaagatcaagaaaacgtgaatgaagcagaaatggaagaaatttatgaatttgcagctactcagcgaaagcttctccaggaagaaagggcagcgggtgccggcgaggacgctgactggctggagggtggcagtccggtttctgggcaactcctagcaggtgtccaggtgcagaaacagtgggacaaggtggaggagatggagccgttggagccaggaagagatgaggccgccaccacctgggagaagatgggacagtgcgctctcccgccaccccagggccagcactcaggggcacggggagcagaggcccctgagcaggaggcgccagaggaggcgcttggccattccagctgctccagcccttccagggactgccaggcagagagaaaagaaggctctcttccgcactcagatgatgccggggattacgaacagctcttctcatcaactcagggagagatctcagagccgtcccaaataacaagtgagcccgaggaacaaagtggcgctgtcagggaaagggggctggaggtttctcatcgcctggctccctggcaggcatctccaccgcacccgtgccgcttcctattggggcctccccagggcgggagtccccgcgggtctcatcacacaagtgggtcgtccctgtcaacaccccggtcccgtggcggaacttcccaggtgggctccccaaccttgctgtctccagctgtgccatcaaagcagaaaagggacaggagcatcctcacgctgtctaaagagccagggcaccagaaaggcaaagagcgtcggtccgtgctggagtgcagaaataagggggtcctgatgttcccagaaaaatctctgtctattgacctaacccagtcaaatcctgaccattcgagctccagatctcagaaatcttcatccaaactgaacgaagaagatgaggtcatcctcttactggactcggatgaggagctggagctagaacaaaccaaaatgaagtccatttctagtgatcctctggaagaaaagaaagctctagaaattagccctaggtcctgtgagctgttttccatcattgatgttgatgcagatcaggaaccttcccagagcccaccaagaagcgaagctgtgctgcagcaggaggatgagggggcgctgccggagaatcggggctctttgggcaggagaggggctccctggctgttctgtgaccgtgagagcagccccagcgaggccagcaccacagacacctcgtggctggtgcccgccaccccgctggccagcagaagccgtgactgttcttcccagacccaaatcagcagcctcaggagcgggctggccgtgcaggcggtgactcagcacacgcccagggcctcagtaggaaacagggaagggaacgaagtcgcacagaagttttctgtcatcaggccccagacaccaccgccccagacaccgtcctcatgcctcactcccgtctctccaggaacttctgacggcagaaggcaaggccacagaagcccttcccgtccccaccccgggggccacccgcactcctctccgctggctccacatcccatctcaggggaccgcgcccacttcagcaggcggttcctgaaacactcgccgcctgggccaagcttcctgaaccagaccccagcgggtgaagtggtggaagtcggagacagtgacgatgagcaggaggtggcctcccatcaggccaacagaagccccccactggacagtgaccccccaattccaattgacgactgctgctggcacatggagcccctctcgccaattcccattgaccactggaacctggagcggaccggccccctgagcaccagcagccccagccgcaggatgaacgaggccgccgacagccgtgactgtcgctccccgggactcctggacaccacccccatccgaggaagctgcactacccagaggaaattgcaagagaagtcctcgggcgcgggctccctggggaacagcaggccgagctttctgaattcggctctgtgggacgtttgggacggggaagagcagaggcctccagagacccctcctccggcccagatgccaagcgctggtggagctcagaagcccgaagggttagagacacccaaaggtgctaatcggaagaagaacttgccccccaaagtgcccataacgccgatgccacagtattccattatggagacgccggtgctgaagaaggaactggataggtttggagtccgccctctgcctaaacgccagatggttctgaagctgaaggagatattccagtacactcaccagaccctggactcagactccgaggacgagagccagtcctcacagccgctgttgcaggcgcctcactgccagaccctcgcctcccagacctacaagccttcaagggcaggggtccatgcccagcaggaggccaccacaggacctggggcccataggcccaagggacctgctaagaccaagggcccccgacatcaaaggaagcatcatgaaagcatcacacccccaagcaggtcgcccaccaaggaggcacctccaggcctcaatgatgacgcccagatcccagcctctcaagaatccgtggccacctctgtggatggcagtgacagctccttgagctcacagagttcttcctcctgtgagtttggagcggcatttgagtctgcaggtgaagaggagggcgagggggaggtcagtgcctcgcaggcagccgtgcaggcggcggacacagacgaggcgctgaggtgctacatccgctccaagccggccctgtaccagaaggtgctgctgtaccagccctttgagctgcgggagctgcaggcagagctgaggcagaacggcctccgtgtgtcctcgcgcaggctgttggacttcctggacacccactgtatcaccttcaccactgccgccacccgcagggagaagctccagggcaggaggcggcagcctcggggcaagaagaaggtggagcggaactgatggggccatcccgaccccaccccaacctgccatcagcagcccccacccccgccatttgcagggaggacctgggacacccagcgtgggtcaggcctccacaggcatttctgggcctggggaccacatcagctctgcgctgtgatgatgaccacagcccaatccagggcttcctcctctgggctctgctttctagggtggcatttggagcatgtcacccactggatttacagactccagccccttcctctgtccgtgctcacagtgtgtctccctttttggttttctttttttttttctttttgagacagtcgtgctgtgtcacctaggctggagtgcagtggcacaatctcggctcactgcaacctccgcctcccgggttcaagcaattctcctgcctcagcctcccagatagctgggactacaggcacacgctgccacgcccagctgattttttatattttagtagaaacggggtttcaccatgttgctcaggctggtcacaaactccagagctcaggcaatccgcctgctgcggcctcccaaagtgctgggatcacaggcgccagccactgcgcccggcccagtgtgtctcccttaacccaagagggccctcagctgtcccagggggcagtgggccatcaccagctggccagggcatggcctattctgccacatttgccaccctctgagcccaccagtcctgggcacagctgccctacatgtctgtcctgagatggacgtcaggtccagcctgccccggcagcccgggcccgtcctcctcagcactcaggccaaccccagccaccgccagcctgagaccaggtgtcctgaggctccctgcactgccacagcccagatgcagttctcctgacccagccgtgctacccggacacttgtcattgttaccagcagtctccaaactggacagtgcacaagggcccagaacaactctgatgccaccacaaaacaaacatgttcactagcggattccattctttgggttaaagctgcctccagcctcaggagcagtgtggaggaagatgagggccaggaaagaaggaaaccttggtttctccatccttgtgaatgtcctcgtctgtttcaaatacagtgcagtcagttttatatgatgtgcaataaaccaaaaaggctttattaaaaaaaaaaaaaaa

SEQ ID NO: 28 - DNA, 2133 bp, Homo sapiens
tggggttccagttgcctctctcgggtcctgcccatgcctcccccgctcctaacccaactttagttcggtgttttcctcgggctttgtctctatcccagccccttctcccaagcggcgggggcgaacgctttgtttcctttaaagtcacttcttccctgggtttaaggtttcccgcgattccacctctggccggttgtcagtgtctgagggaagtagtctggatgaagtggtgtccaaagtcacatgtcagcatggatccgcatcctttttatttgacaagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaaaggaagctgcaagtggattcgaactcctgcaatcatctactctgttcacaccatgacaaccttaattccgatactctccacatttctgtttgaggatttctccaaagccagtggtttcaagggacaaagacctgagactttgcatgaacggttaacccttgtgtctgtctatgccccctacttactcatcccattcatacttttaattttcatgttgcggagcccctactacaagtatgaagagaaaagaaaaaaaaaatgaaggaaacaaccactggcccagggtagagatgcctacagggtggttgcttgttggatacaatacaaggaacactgctcagaacccacgtcttcagcagcatttgaaacactggcagcaatgcacaagagcaagatggtgtcaggaaccatgtcaaaccctcaccttcttccatttttttttttttttttaagacagtctcactctgttgcccaggctggagtaaagggcagtggcatgatctcggctcactgcaacctccgcctcctgggctcaagccatcttccttagcctcccaagtagctagaactacaggtgtgtaccaacacgtatggctaatttgttttgttttttttgtgtgtgtggagacagggttttgccatgttgcccaggttggtctcgaacgcctaggctcaagtgatctgcccacctcagtctccctaagtgctgggattacagacgtgaaccactgggcccagcccaaaccttcaccttctaagggcactgggatgaacggaccgatcggcttgagggtgggcaaaggggtgtgggctaggttataaggaagtggtaccaaataactgtgtgcctgagttccaccgcaagattactaaaagcaggaccagaccagaaactgctaaagaacatggcctgtttgacatgttcatgagtcacctgacccacagcatatatgcttgtgactaaaccctccactcctgattctcaagagtgtatcacctgtcagcaaaatgaatagtgggatattttgggccattttaaatgtgaaattttgcctctttaatgttaattcaaaactatatcaatgttttcttgttcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttgtttgtttgcttttaaattagtttatttctaaatcttagtcttccacatttctagaggccacctgacacaagtccctgtatctgaagtctagcatctcaaggctgatctggaagtgtgctagtatgctccctagtggataacttaatcttttaatacagttccgtcattcccatcttgttttcagaagagaaggtggctacagccaggcataacatatccactgtgtgcatagagggtctcttcacgttgatgcttggcattccatcagctttctctaagtctttgctcaagttcaaccttaaaatgatgttagacaacaggtcccagtcagttccctctattttcacccattttgctcacaagccatattggcccgattagtggtactgtctgactcacgtgtgtgatccaaataaaggtagctgctgaccaaaaaaaaaaaaaaaa

SEQ ID NO: 29 - DNA, 2579 bp, Homo sapiens
gtgaccttgtggggaaaggagccaagaacggggcgtcggggggcctgggacccccctgcctgagagatacaggaatcctggccccgtgttgtggacacaagcgcccatcctcaaggtcctgagaactcctgaacttccaaagcctggagagtcaccgccgagggatgaggacgcgccagcccgggggaacgcgccagctgctttcgcggccccaagcgcgcagtgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcactttacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcttcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctaaaaaaaaaaaaaaaaaaaaaaaaaaaaaaaaaaaaaaaaaaaaaaaaaaaaa

SEQ ID NO: 30 - DNA, 1406 bp, Homo sapiens
cttctgtgagcagcgaggattttgatatgagcgactccacatggatgtcagctgacccgcacctggcctccagcctgagccccagccaggacgagaggatgcggagcccgcagaacctccacagtcaagaggacgatgactcctcctctgagagtggcagcggcaatggctcctccaccctgaacccatccacgtcgagcagcacgcagggcgaccctgccttccccgagatgaatggcaacggcgccgtggcccccatggacttcaccacggccgccgaggatcagcccatcaacctgtgtgacaagctcccgccggccacggcacttggcacagcctcctacccctcggatggctgcggtgccgacgggctgcggagccgcgtcaaatacggggtgaagaccacccccgagtcccccccctacagctctgggagctacgattccatcaagaccgaggtcagcggctgccctgaggacctgacagtgggccgggccccgacggcagatgatgacgacgatgaccacgatgaccatgaggacaatgacaagatgaacgactctgaaggcatggaccctgagcgtcttaaggccttcaacatgtttgtgcgtctctttgtggacgagaacctggaccgcatggtgcccatctccaagcagcccaaggagaagatccaggccatcatcgagtcctgcagccggcagttccctgagttccaggagcgggcccgcaagcgcatccgcacgtacctcaagtcctgccgtcgcatgaagaagaacggcatggagatgaccagacccacgccaccccatctgacctcggccatggcagaaaacatcctggcagctgcctgtgagagcgagacaagaaaggcagccaagcggatgcgtctagagatctaccagtcctcacaggatgagcccatagccctggacaagcagcactcgcgggactccgcagccatcacccactccacctactcactgccagcctcctcctactcccaggaccctgtgtacgccaacggcggcctcaactacagttaccgcgggtacggggccttgagcagcaacctgcagccccctgcctccctccaaacaggaaaccacagtaatgggcccacggacctcagcatgaaaggcggggcctctaccacctccaccacccccagcgccttgtcgggggagcccccaacaaggcgctggggctgcagctctgtttagaatcaccttcgtggaccctgatgttagaatcccacccccagataattacctttcaagtcttaggtgagcagaattgcatatttattgagaaaagcaaagtggaccctttcttcctctccccttagtaatttatttttctgaaaatggaaaaaaaaaaaaaaaaaaaaaaaaaaaaaaaaaaaa

SEQ ID NO: 31 - DNA, 2851 bp, Homo sapiens
gcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaaaa

SEQ ID NO: 32 - DNA, 2396 bp, Homo sapiens
cacatagctagtaagttctagctagcactgagtgctgtgcccgtgaaatttatctacataggctttcacttaacctgcagacagaactcagttagtcggggacaatttccctcaatgttaacagcactgttccaccgcaacgtggaacaacagctttaaaacgtgctcttcgtaggcccggctactccaagaacagtgcctcccgccagacccaggcggcttccttcacccgcaacccgagagacgacccgccgggcccgccccgcggaagccgccggttgccaggccaaggagtggactagggtcgccggggaagcggtttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaaacaaaccccagcagaatcaggatagctttgggaaatgaagcaagcacagtgcaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggtggttctgtaataaagtacagcaaaaatactactcgtaagcagtggctcaaagagacccctgacactttgttgaacatccttaagaatgctgatctcagcttggcttttcaaacatacacaatatatagaccaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcgagctggatggcaaggcctgtgcgacagataatgcctgaggaaatgttcctgagtcacgctgaggagaggcttcactcaggagttcatgctgagatgatcatgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatatatttaattatgattta

SEQ ID NO: 33 - DNA, 743 bp, Homo sapiens
gaggatcatagagctgtctggcgcagcgaggcctcccggcgccaccgagacgcgcagaggacggctagagcgttgctcgccgagagacttcctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaaaaaaaaaaaaaaaaaaaaaaaaaaaaaaaaaaa

SEQ ID NO: 34 - DNA, 7357 bp, Homo sapiens
gcactgctgatgaaacctggcgccggaacccgccagccctcggcgcccattcagtccgcgcaggcaggtgtgagcagcgggtcaactacctggcaggcgcgcacgcggccgcgggctcccgctaaccgcagcctccactcctctccccgcgcgccgcgcccccgccccgccccgccccgcccggtctcgccggccgagcgtccgttggtccttgagcgcgtccgacagtctgtctgttcgcgatcctgccggagccccgccgccgccggcttggattctgaaaccttccttgtatccctcctgagacatctttgctgcaagatcgaggctgtcctctggtgagaaggtggtgaggcttcccgtcatattccagctctgaacagcaacatggggtgcaaagtcctgctcaacattgggcagcagatgctgcggcggaaggtggtggactgtagccgggaggagacgcggctgtctcgctgcctgaacacttttgatctggtggccctcggggtgggcagcacactgggtgctggtgtctacgtcctggctggagctgtggcccgtgagaatgcaggccctgccattgtcatctccttcctgatcgctgcgctggcctcagtgctggctggcctgtgctatggcgagtttggtgctcgggtccccaagacgggctcagcttacctctacagctatgtcaccgttggagagctctgggccttcatcaccggctggaacttaatcctctcctacatcatcggtacttcaagcgtagcgagggcctggagcgccaccttcgacgagctgataggcagacccatcggggagttctcacggacacacatgactctgaacgcccccggcgtgctggctgaaaaccccgacatattcgcagtgatcataattctcatcttgacaggacttttaactcttggtgtgaaagagtcggccatggtcaacaaaatattcacttgtattaacgtcctggtcctgggcttcataatggtgtcaggatttgtgaaaggatcggttaaaaactggcagctcacggaggaggattttgggaacacatcaggccgtctctgtttgaacaatgacacaaaagaagggaagcccggtgttggtggattcatgcccttcgggttctctggtgtcctgtcgggggcagcgacttgcttctatgccttcgtgggctttgactgcatcgccaccacaggtgaagaggtgaagaacccacagaaggccatccccgtggggatcgtggcgtccctcttgatctgcttcatcgcctactttggggtgtcggctgccctcacgctcatgatgccctacttctgcctggacaataacagccccctgcccgacgcctttaagcacgtgggctgggaaggtgccaagtacgcagtggccgtgggctccctctgcgctctttccgccagtcttctaggttccatgtttcccatgcctcgggttatctatgccatggctgaggatggactgctatttaaattcttagccaacgtcaatgataggaccaaaacaccaataatcgccacattagcctcgggtgccgttgctgctgtgatggccttcctctttgacctgaaggacttggtggacctcatgtccattggcactctcctggcttactcgttggtggctgcctgtgtgttggtcttacggtaccagccagagcagcctaacctggtataccagatggccagtacttccgacgagttagatccagcagaccaaaatgaattggcaagcaccaatgattcccagctggggtttttaccagaggcagagatgttctctttgaaaaccatactctcacccaaaaacatggagccttccaaaatctctgggctaattgtgaacatttcaaccagccttatagctgttctcatcatcaccttctgcattgtgaccgtgcttggaagggaggctctcaccaaaggggcgctgtgggcagtctttctgctcgcagggtctgccctcctctgtgccgtggtcacgggcgtcatctggaggcagcccgagagcaagaccaagctctcatttaaggttcccttcctgccagtgctccccatcctgagcatcttcgtgaacgtctatctcatgatgcagctggaccagggcacctgggtccggtttgctgtgtggatgctgataggcttcatcatctactttggctatggcctgtggcacagcgaggaggcgtccctggatgccgaccaagcaaggactcctgacggcaacttggaccagtgcaagtgacgcacagccccgccccccggaggtggcagcagccccgagggacgcccccagaggaccgggaggcaccccaccctccccaccagtgcaacagaaaccacctgcgtccacaccctcactgcagccaaaggtgcaattacttgacctgcagccccagcccaccctcggctctgcagccggttctccgggccctggtcacctccagacagctgcctggccggggccactaggctgcggctggccactgtgtctcctcacttctctgaacaaagcagttcctcccctaccagctcagccccgagctgccgcagcctcaggcagaacggaggtcaccttctctccttatcttgggaaccaggccttcctcccggggactgttctgggattgaaattgtgcatactccaaactttcgcagccatcttcccgctcagccccagacacccagcaatcaagccagatgagtaccacaaaacagtgtgtccccagcagctccccaccccagagccaaatgacagtagtgcacttaaaaaggaaaatcaggcctgttgtccttctccggttgcattcagatgggtcattagggccggaccctgcctgccccttggcttctcagggctttgctctgacaccatgacagctgcccggggctgagggcagctggctccactcaaatgaggaagaagggatcactcccattagggcctgctttgcttatgcatgtgtgtgcacatgcatgtaaaccagggaccttcagctcacggcctccaggcctgggccagttcttgctgctcctgccgtctcccccgactggctgtgtcctgagtaactggaacatgagacagtatctgcaggactggccccatggtggccgagtcagaagtctgtttcctgtgagtcgccaccgttcactcagtcttgccctcccatgctttggagccagtctggtggctcctgtaaggttctcaaggctggtggcagctcagtctggggtcaggacatgtcggggtcatgcgtttctggccctgacataagctgtctggcctctctgtgacatgatgaaattgaaatcaatccacagtccatgaaattgtgacactccaccagattaagttagggcataacattaacttggaaatggccatgtcatcacccctgcggctgtcctatagctgagatgcgtgggtcgcaggggaggtgatttctaggcatattgctgtcccttttgtgtatctgtcatccggatgcttcggaccccacgcctctgcaagtgggagagacccgagcatcctccccacccccatagctccagtgcacgccacccccgtcttgcctgggtcggggcctgcggccagcaccatttcacacacactccttgtagatgggagccagaggaaacctgaacgtgggtggagcgttccactgagtctacttcaggagacagaaggcccatgctgatgggggaggaggagggatgtgggcattttggacaccaggggaaatggaaatgctgctttcaaaacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcggtggagggcgggtggatggccatgggctgagcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggttttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgagaggggagtgatttaagcaatggtgtctggagtaagccttacaattttaatagactttttcttatcatatccctcatttctttccctgaaataaaaatacacacaagcaaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggcccaaattcatgaagcagcaaacccagcagatctccacccccctgcctcaggacctctgctgaagagggggatgaagtgggtctccagggaggcagtgggggccttgttggcagctggctcgggagccggcttacaggagggcagctctgcagttgggaggggcaccgtccggaggagaccaggcctctacacaccccccactctacttatcatccctgctcacacacccttgtccaaggctttatgcatcggatttatttttccaaatcaagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtggggggcacgtggacatgccccataggggccccacccagacttaacaggcaaggtcctgggcattgcgcgacgcaggactcaatgctaaagcaagcctgcctggctctgtgccagggcccctcttctgattcacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctggggaccttatccgagtcatgaaattgattactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcactcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcgaataaattctatggcttccaaaaaaaaaaaaaaa

SEQ ID NO: 35 - DNA, 738 bp, Homo sapiens
agtccagacagcctgggaggggagaaggagttggagctcaagttggagacagcgaggagaaacctgccatagccagggtgtgtctttgatcctcttcaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaaaacaaaaaaaaaa

SEQ ID NO: 36 - DNA, 2810 bp, Homo sapiens
gcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaagttaaaaaaaaaaaaaaaaa

SEQ ID NO: 37 - DNA, 6256 bp, Homo sapiens
gcggccgccgcctccgccccgcgttcggggccttcccgaccctgcactgctgccgtccgcccgcccggccgctcttctcttcgccgtgggagccgctccgggcgcagggccgcgcgccgagccccgcaggctgcagcgccgcggcccggcccggcgccccggcaacttcgccgagagttgaggcgaagtttgggcgaccgcggcaggccccggccgagctcccctctgcgcccccggcgtcccgtcgagcccagccccgccgggggcgctcctcgccgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctgaaaaaaaaaaaaaaaaaaaaaaaaa

SEQ ID NO: 38 - DNA, 1620 bp, Homo sapiens
agtccggggcggcgcctggaggcggagccgcccgctgggctaaatggggcagaggccgggaggggtgggggttccccgcgccgcagccatggagcagcttcgcgccgccgcccgtctgcagattgttctgggccacctcggccgcccctcggccggggctgtcgtagctcatcccacttcagggactatttcctctgccagtttccatcctcaacaattccagtatactctggataataacgttctaaccctggaacagagaaaattttatgaagaaaatgggtttctagtaatcaaaaatcttgtacctgatgccgatattcaacgctttcggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttgaaatagccatctgctataactctttcaacagaaaaccaaaaccaaacgaaatgtctaaggaaaatgttttcttaatgagatgatgtaaccttttctatcacttgttaaaagcagaaaacatgtatcaggtacttaattgcatagagttagttttgcagcacaatggtgttgctttaatggaaaaaaaaaacagtaaaagtgaaatattactgttttaaggaaaactaatttagggtggcagccaataaaggtggttggtgtctaatttaagtgttaaatcaatttctttcattcagttagctctttacccaagaagaagtgaatgatttggagcttagggtatgttttgtatcccctttctgataaacccattccctaccaattttatgtcataagagatttttttcccccaaatctagaacaatgtataatacattcacatctagtcaagggcataggaacggtgtcatggagtccaaataaagtggatattcctgctcggacaaaaaaaaaaaa

SEQ ID NO: 39 - DNA, 3366 bp, Homo sapiens
ggttgcgcgtgtgccatggactcagccgcccggtgatattgacaataggagagagaaaggggcattgactgggacccaccgcgggtagcgaaaggtggctctggcagcggcggctccagctcctgcggctcctcctccttattctgtccccttctcttgctgccgctgcagatccagtcttcctccctcccttccccccctccccacgtcgtcgccgccgccgccgggtccggggcaacgagctgaggcgccgcccgccaggaatgtgagcgaggagccaccggcggagccgcaacggggtcggtgccgatttgatgggacgggcccgcgggggaggatcgtgaggccgccgccgccaccggaacgctgaggttcgggtccggccgtgaggcctagaggctccgccgccgcggaaccggagggaccccgtaccggacagccgtcgccccaggctccccgcagctgcccggacctccccctgcacgtcccggtcccgccgcccgcccccgctgcggccacctcgcccgtctcccgcccctccaagccacagatcatctttggattcttccccagaagcttcaagtagggatatgtcctcagcaccaactactcctccatcagtggataaagtagacggattttctcggaagtccgtcagaaaagccagacagaagaggtcgcaaagttcctcacagtttaggtctcaaggcaagcctattgagttaacacctctgccgctgctaaaagacgttccatcctcagagcagcctgaactgttcctaaagaaacttcagcagtgctgtgtcatttttgacttcatggacacgctatctgatcttaaaatgaaagaatacaagcgctccactcttaatgaactggtggactacattacaataagcagaggctgtttgacagagcagacttaccctgaagtagttagaatggtatcttgcaatatattcagaactctccctcctagtgacagcaatgaatttgatccagaagaagatgaacctacccttgaggcatcgtggccacacttacagcttgtatatgaatttttcatacgatttttggaaagccaagaattccaacccagcattgccaaaaaatatatagatcagaaatttgtattacagcttctggagctatttgacagcgaagaccctcgggaacgggactacttaaaaacagtcttacacagaatttatggcaagtttcttggtcttagagcatttatccgaaaacagattaacaatatttttctaaggtttgtttatgaaacagaacacttcaatggtgtagctgaactgctggaaatattaggaagtattatcaatggctttgctttacctcttaaggcagaacacaaacagtttctggtgaaagtattgatccctttacacactgtcaggagcttatcactcttccatgcacagctggcatattgtatagtacagtttctggagaaagatccttcactcacagaaccagttattagggggttaatgaaattttggcctaaaacatgtagtcaaaaagaggtcatgttccttggggaactggaagaaatattggatgtgattgaaccttcacaatttgttaaaatccaagaacctttgtttaaacaaatcgccaagtgtgtatctagcccccattttcaggtggcagaaagagcactctattattggaataatgaatacatcatgagtttgatagaagaaaactctaacgtcatccttcccatcatgttttccagcctttataggatttcaaaagaacattggaatccggctattgtggcgttggtgtacaatgtgttgaaggcatttatggaaatgaacagcaccatgtttgacgagctgacagccacatacaagtcagatcgtcagcgtgagaaaaagaaagaaaaggagcgtgaagaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctcttttaaaaaaaaaaatcggtcttcaaagatctgttgatgaaattgctatgttaaaattccattatcgggagttccttatttatcactagcagagagtatgatacaattttcaaatgtgaacaatcttaaatttagcttgtctttctgctaagctgttaaatgtatttatagtaaaggaagaaaaaaagactgtcatttccttataagtttgtgtaacatcctcctctggataacttgactgtaatttaacatctttttcttttgcacatcttcctgagttgaatgtccacgtggaatggggtcatgaattataaaagtccctgataaaagttttgtttactggggtgaacatctttccagtaaccaggtagtcctggtactcctttagttttaaaattaggagttaagagagaagaggtgataaacatagtagggaagggaatatcggattcatgcatcagtttatggtgaatccaaatcaatgtcttgaatcctttgaaaacaggcactgggacatcacaggcttcagtacctgaccagtattagttgcatatatcattgaacacacataccagagatgttttagaaatgtgagaaaaacatccttttggaccatttgaaataagaaagacaaacactaaacaatacaaccatgaaattgatcaccgggattgcaaatctaattgggaaaagagttgagcaaacagcttggactgtttggagttgttgccttactttttaatatgtatttataaagtattccagcaaaagaggatgtagcctctgggaaaaaacaaacatgttacagtgttttttgtagattctcgttctatatctcatcacagcgccagccctgtttttagccggaaaggattcaggataaacattattatgcattctgaattggatgcatattcctaactactgtatttgttaccaaaagtggttctacaaatgctactgaaaaaaatctggaaattcctaatgtcctgagtattaataataaagtttaaaaatgcttttatatcaaaggtgcatcgtgaccaaattgtttaagaaaaaaaaacaaaaaaaacaaaatctagggctgtattttatatatatatatatatatatatatatatatat

SEQ ID NO: 40 - DNA, 1888 bp, Homo sapiens
gtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcattatttgcagtgggaaaaaaaaaaaaaaaaaaaaaaaaaaaaaaaaaaaaaa

SEQ ID NO: 41 - DNA, 2418 bp, Homo sapiens
tagagacacttcctgtggcagagaaaagaggtagtgagcggtgtttcaggatgtgagggcccgcaggagccgagtcaggctctctccactgcctgcccgccaccgtgcaagctctggccggcgctgcccacagtccccatggtgggcagcccccgcggcggggacccctgatcggcagcggcatgccagggaagcccaagcacctgggcgtccccaacgggcgcatggttctggctgtgtcagatggagagctgagcagcacgacggggccccagggccagggcgagggccgcggcagctctctcagcatccacagcctccccagtggtcccagcagccccttcccaaccgaggagcagcctgtggccagctgggccctgtccttcgagcggctgttgcaggacccgctgggcctggcttacttcactgagttcctgaagaaggagttcagcgcggaaaacgtgactttctggaaggcctgcgagcgcttccagcagatcccggccagcgatacccagcagctagctcaggaggcccgcaacatctaccaggagttcctgtccagccaggcgctgagcccagtgaacatcgaccgtcaggcctggcttggcgaggaggtgctggccgagccccggccggacatgtttcgggcacagcagcttcagatcttcaacttgatgaagttcgacagctatgcgcgcttcgtcaagtccccgctgtaccgcgagtgcctgctagccgaagccgagggacgccctctgcgggaacctggctcctcgcgcctcggcagccctgacgccacgaggaagaagccgaagctgaagcccgggaagtcgctgccgctgggtgtggaggagttggggcagctgccacccgttgagggtcctgggggccgccctctccgcaagtccttccgccgggagctgggcgggactgcaaacgccgccttgcgccgagagtctcagggctccctcaactcctccgccagcctggaccttggcttcctagccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcacccccaatcccttgcagccaggccacaatgggggaggtgagtccagccccttggaacaggcttgcccaacatggagggatggcgttggcagtgccagcctccccagcctgtgccaagcttcaacaggggcaagaggaggggccggcccctcctcaggaagctggtatgagtaaggccttgagggtgcaggcaggcagccctgtaccccacccacatagactatactgtacatacagattttgcagtaggcttggggcagctgggtttgtccttgatgtatgatactgttattataataattattattattctgccaaaaaaaaaaaaa

SEQ ID NO: 42 - DNA, 543 bp, Homo sapiens
gaccttgagggagttaatgtgtaatattctaggatataagcttgaccacgagttgagaccctgagcacaggcctccaggagccgctgggagctgccgccaggagctgtcaccatgacgggggaacttgaggttaagaacatggacatgaagccggggtcaaccctgaagatcacaggcagcatcgccgatggcactgatggctttgtaattaatctgggccaggggacagacaagctgaacctgcatttcaaccctcgcttcagcgaatccaccattgtctgcaactcattggacggcagcaactgggggcaagaacaacgggaagatcacctgtgcttcagcccagggtcagaggtcaagttcacagtgacctttgagagtgacaaattcaaggtgaagctgccagatgggcacgagctgacttttcccaacaggctgggtcacagccacctgagctacctgagcgtaaggggcgggttcaacatgtcctctttcaagttaaaagaataaaagacttccagccgagaaaaaaaaaaaaaaaa

SEQ ID NO: 43 - DNA, 3430 bp, Homo sapiens
agacgtttcccgccggcgggagctgtggctgtgattgagagaggggttagaggcgggtcccagcgctgccgcaccatggcggaccagctttatctggaaaatatagacgagttcgtcacggaccaaaacaagatcgtgacatacaaatggctgagctatacactaggggttcatgttaaccaggccaaacagatgctgtatgattatgttgaaaggaaacgaaaagaaaattcaggagcccaactgcatgttacctacttggtgtctggcagtctcattcagaatggacattcctgccacaaggttgcagtagtgagagaagataaattggaagcagtgaagtccaagctagctgtgactgccagcatccatgtgtacagcatccagaaagccatgctaaaggacagtgggcctctgttcaatactgactatgacatccttaaaagcaacttgcagaactgcagcaaatttagtgctatacaatgtgcagctgccgtccctagagctcctgctgaatcctcttcgtcttccaaaaagtttgagcagtcacatcttcacatgtcaagtgagacacaagccaacaatgagctgaccaccaatggtcatggcccacctgcatccaagcaggtttcccagcagcccaaaggaattatgggaatgtttgcctccaaagctgctgctaaaacccaagaaaccaacaaggaaacgaaaacagaggctaaagaagtaacaaatgcatctgcagcaggcaacaaggcaccagggaaagggaatatgatgagcaacttttttggaaaagctgctatgaataaatttaaagtcaatttggactcagaacaagcagtgaaagaagaaaaaatagtggagcagcctacagtgtctgtcacggaaccaaagctggcaactcctgcaggcctgaaaaaatccagcaaaaaagcagagcctgttaaggtgctgcagaaggaaaaaaaaagggggaagcgagtagcattatctgatgatgagacaaaggaaactgaaaacatgaggaaaaagaggagaagaatcaaacttcctgaatctgatagcagtgaagatgaagtctttccagactctcctggggcttatgaagctgagtcaccatccccacctcctcctccgtctccacctcttgaaccagtgccaaagactgagcctgaacctccttctgtcaagagctcaagtggagaaaacaaaagaaaacgaaaacgcgtactaaaatctaaaacttacctggatggggaaggctgcatagtgactgaaaaagtctacgagagtgaatcctgcacagatagtgaagaggagcttaacatgaagacatcctcagtacacagaccccctgccatgactgtgaaaaaagaacccagagaggaacgaaagggccccaagaaagggactgctgctctgggcaaagccaacagacaggtgtccattactggcttcttccagaggaaataaactgccatctctggtagatcagagacttggagtggtcaagggagaagaccaagaaatgtactcctcacttactatgtaagttcatctagatctccacctcacctgtatcaaaagactgttctttcatcctgtgaggtttatactatttctggtttttaaccaaaaggaaatcatctggaagcaggaggcaaaaagctgttaccttctaatgacatttaaaaagcacagtctttgacctgtccaggagaaggatttactccaaaattatactggaacagttttcagaattctcactgaagccatttagtggctaacccactgtgctccactcaccctatgccctggtccgcatatggcacaggaattattccttcttgttcctctgtattctaagaattcatgtgggtgtttcttatccttacattctgctggatacgtttacccctcttgtcttcctgcagtaccacacttctgtcccctaacctcctgaggctgttctctgtaagtcttttaagttttggttggactaaaggctgaagtgaaaatctccctgtaatcctcttcctccattatgcagtacacggacacctggctacagaccaggacgtggcttgtgttctgttcctttcacaaaagctctctgggaccttcacttgcaattagtggttagggaaaagcctcaggcagaacacaaatagaaatttaatgatgtgttcaactccaccagaaattacctcgagtcagcattgacgatattggaggagctgccgtgctgctgatacggggtgtgctttatgctgctctttgcggtttgttgatcccctcctcccccactctcaatacctagagagtgaaacccgtacaatgagataaagactaaaaagagaaatcccttcctatatacagtgtgctacatttacaaaaaatttctccttaagaaaacagaatattcaaaaacagcacttttccaggaagttagtgaggaagataaggcacacatttatttataaatggatgttgctcctttgtatttttagcttccctatttgcttaaaagtacaggctccctaagagaggatggagagggagagactgaattgttagtaggtctaaacatcaaagaaaacatttttattagttacttatggaaaatcatctattacaatgataaccttcaagtgacttccattatggctggacaggcggtgagctcagtggattgcagtggtgtgctggtgattttgcacagtgagctctgcggaaggggtcaggctcaactgctgatgtgtctcacacgtagcagacaaggggtgtctgactggcttcttttgcctcaagatggtgtatgtcgtaagtgatgcaatcagctgtctgctttttaaggttgggattgtgctgactttgggattaacatgagcttctttagcaaccaagcatgaacttgattaagaccagaagtttgggagatgagtcctggcattatgtctaggactaaagcagtggctttgtatagcaagctgagtaaaggttgacatattccaaaacccttctttttaaaatgaaaaaggatggagagaaggatggaaagcctggacttaaacctttagaaaaaacttctggagagaaatcccttttaaacagttacttttgtcattgcctctggtcatttgtctaaataggaatggaaaattaaaagaaaagcaacaatccaatcttttttctaaaaattatgctggggtctcgactaaaactgaatttgaattggaaaattctggtgttggttggagttccatcttgcaagggataatacaaatcctatgatctctatgcccaatatgctgcctcaactctgagctgtctgcaaggcttagtaagtattgagtggtgttttttttttctttttatacaataccatgttaaccacatgagttaaataaatttgagaagttgtttt

SEQ ID NO: 44 - DNA, 798 bp, Homo sapiens
gccaacagaaatccattacaatatataagagctaagatttcttgtcccttttcacctttatttgccgtctttcaactggcaagagtcattttgaccagcagattaatcaactgtaagacagatcctcacacaaagaggcaactgaaaggatgaaatcactgacttggatcttgggcctttgggctcttgcagcgtgtttcacacctggtgagagtcaaagaggccccaggggaccatatccacctggaccgctggctcctcctcaaccttttggcccaggatttgttccaccacctcctcctccaccctatggtccagggagaatcccacctcctcctcccgcaccctatggtccagggatatttccaccaccccctcctcaaccctaaggtccaccactccatcctgatgccccaggttatccacagcctccttcccgaccaagaccctatccacctggacctccatttttccctgtaaattctccaactgatcctaccctccctactcctgcaccccaaatatgaacaactgcagcaggtgccaccaccaccacaaaagacaccactacccttgtaactactgcttctactacccaaaatatgaattccaacactgcttccaagagacatttacataaaattgcttccatttttggatgagaatgaaaaattccaaaagtgctgagctttggggagaaataatcttagaaagaaattgtagaaaaaacccatgcagacataacatttataccaatgaggcaaaaataaagaattgagcaccaaaaaaaaaaaaaaa

SEQ ID NO: 45 - DNA, 3351 bp, Homo sapiens
gggtggagcgcggggagccaggcgaggggccgcgacgacgggactccattagccgctccggccacaggcagcgcttcgccagccgaggaaccggacgcggacaccgccgccccgcgagcctccagcccctcgcctgttgccgcgcgagtcccgggcccggagcgctaggagcgcgcggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaataggaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttgtcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaataaaaaaaaaaaaaaaaa

SEQ ID NO: 46 - DNA, 1614 bp, Homo sapiens
gggaagctcccctccgagactctggatagccgccgggggggcgttgcctggccggctggttgcgtagcaacggcaggcggtgcgtgacgtgcgcagccgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgagta

SEQ ID NO: 47 - DNA, 4071 bp, Homo sapiens
tgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagatcctcgtccctcccaagatgttgtttacacgaggggcttcataacggattctaacggaagacactgaaaagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagataggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagatttttttaatttatattttcatcctgaccagcttagttctaataatttttagttgtgagtgattaaaaaactttggatcaattttggtcaaacatgccaactttgtagtctgagtgacaggcaaggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactcta

SEQ ID NO: 48 - DNA, 1808 bp, Homo sapiens
agcctagttacagattgcactgcgtcagactgttccacacccagaagacgtcaggtgacttcagtcctgctgcagttgtgcagcagaggagactgcagacttcggttgaggaaacgggtatttcatgtctcagggagtaggtttgtgcagttacagcttttctgttggtatgcataattaataattggagctgcaaagcagatcgtgacaagagatggacggtcagaagaaaaattggaaggacaaggttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaaaaaaaaaaaaaaaaaaaaaaaaaaaaa

SEQ ID NO: 49 - DNA, 823 bp, Homo sapiens
aaacgcgggcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaaaaaaaaaaaaaaa

SEQ ID NO: 50 - DNA, 1902 bp, Homo sapiens
cggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaggtgcacttgatctatctgatgtacattctccaccaaagtcaccagagggaaaaacaagtgcacagacaacaccaagtaagataccaaggtataaaggacaaggtaagaagaagacaagcgggcagaaggctggtgacaagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccattttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctaaaaaaaaaaaaaaaaaa

SEQ ID NO: 51 - DNA, 3806 bp, Homo sapiens
gcggcttccccgaggccggaggcggggcgggcgggcctcgggtggcgcggggggcggacccgccagctgcctgcgctgctcgccagcttgctcgcactcggctgtgcggcggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaattcttatatgtgtgcatgtgtgttttcttctgagattcatcttggtggtgggtttttttgtttttttaattcagtgcctgatctttaatgcttccataaggcagtgttcccatttaggaactttgacagcatttgttaggcagaatattttggatttggaggcatttgcatggtagtctttgaacagtaaaatgatgtgttgactatactgatacacatattaaactataccttatagtaaaccagtatcccaagctgcttttagttccaaaaatagtttcttttccaaaggttgttgctctactttgtaggaagtctttgcatatggccctcccaactttaaagtcataccagagtggccaagagtgtttatcccaacccttccatttaacaggatttcactcacatttctggaactagctatttttcagaagacaataatcagggcttaattagaacaggctgtatttcctcccagcaaacagttgtggccacactaaaaacaatcatagcattttacccctggattatagcacatctcatgttttatcatttggatggagtaatttaaaatgaattaaattccagagaacaatggaagcattgcctggcagatgtcacaacagaataaccacttgtttggagcctggcacagtcctccagcctgatcaaaaattattctgcatagttttcagtgtgctttctgggagctatgtacttcttcaatttggaaacttttctctctcatttatagtgaaaatacttggaagttactttaagaaaaccagtgtggcctttttccctctagctttaaaagggccgcttttgctggaatgctctaggttatagataaacaattaggtataatagcaaaaatgaaaattggaagaatgcaaaatggatcagaatcatgccttccaataaaggcctttacacatgttttatcaatatgattatcaaatcacagcatatacagaaaagacttggacttattgtatgtttttattttatggctctcggcctaagcacttctttctaaatgtatcggagaaaaaatcaaatggactacaagcacgtgtttgctgtgcttgcaccccaggtaaacctgcattgtagcaatttgtaaggatattcagatggagcactgtcacttagacattctctgggggattttctgcttgtctttcttgagctttttggaaggataattctgataaggcactcaagaaacgtacaaccacagtgctttcttcaaatcatatgagaaatactatgcatagcaaggagatgcagagccgccaggaaaattctgagttccagcacaattttctttggaatctaacaggaatctagcctgaggaagaagggaggtctccatttctatgtctggtatttgggggttttgtttgtttttgctttagcttggtgaaaaaaagttcactgaacaccaagaccagaatggatttttttaaaaaaatagatgttccttttgtgaagcaccttgattccttgattttgattttttgcaaagttagacaatggcacaaagtcaaaatgaaatcaatgtttagttcacaagtagatgtaatttactaaagaatgatacacccatatgctatatacagcttaactcacagaactgtaaaagaaaattataaaataattcaacatgtccatctttttagtgataataaaagaaagcatggtattaaactatcatagaagtagacagaaaaagaaaaaaggactcatggcattattaatataattagtgctttacatgtgttagttatacatattagaagcatatttgcctagtaaggctagtagaaccacatttcccaaagtgtgctccttaaacactcatgccttatgattttctaccaaaagtaaaaagggttgtattaagtcagaggaagatgcctctccattttccctctctttatcagaggttcacatgcctgtctgcacattaaaagctctgggaagacctgttgtaaagggacaagttgaggttgtaaaatctgcatttaaataaacatctttgatcacaaaa

SEQ ID NO: 52 - DNA, 4362 bp, Homo sapiens
aaaaggacaggctgaggctgagcctcagggaggcggggtgcagcttcctcttcacagagaggctggacttgaacaaacccagccttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggatagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcataatgtctcttctattacaaaaattctttcttcataaactgcattagaggtttgcaacaaccacatcatttccattaacttagatttaggttttactggattcattgctcaccattattgcttgtatattacatcttttccaatctttaaaaaaaaaaaaaaaaaa

SEQ ID NO: 53 - DNA, 1465 bp, Homo sapiens
cgcgctcgccggagagctgggtgctaccgctgtttccgctgctgagccctgcccgccggccggcccgctcgctagctcgcttcccctcgcccagggggaaaggtcagcagcgtcctggagccgccgtgtcactccccgaaagccatgaactgcagcgagagccagcggctgcgaacccttctgagccgcctgttgctcgagctgcaccaccggggtaatgccagcggcttgggcgctggccctcgtcccagcatgggcatgggggtcgtgcctgaccctttcgtgggccgcgaggtgaccagcgccaagggcgacgacgcctatctctacatcctgctcatcatgatcttctacgcctgcttggccggaggcctcatcctggcctacacccgctcccgtaagctcgtcgaggccaaggacgagccgtcccaggcttgcgccgagcacgaatgggccccgggaggcgccctgaccgccgacgccgaggctgccgcgggctcccaggccgagggccgccgccagcttgcctccgaggggctgcctgccctcgcccagggcgctgagcgggtctaaaaccacagccccagattgctggttcgcgccctcctcatctcgctcatccctgggcgcgcctcccaccttccacccccaactcccttccagggttcgcctcatctgaggcccagataatggtgagaggccaggagaccttgtctggaaggccctggaaggagaagcaccaccttacccattcgggccagtttctccctcttcacccctgcgcctccacccctaccccgcacatccaactgcactaaactgcctctgctctcttgtcttcagacagccctgacagcacgctccagccctctgggaactgaatccaacacgtccaacacttggcactgaactgaagcaatgcattctatcagaactctgggccgtctaactggcagctgctccaggggctgccagggactgctcactctgcagagccaacgggcttgccaggccgactgcagcagctccagcttccagttgccttagggacagagacaaaggaaatgaagagacctcagacatcttttccctccctctctctttcagcagggagctagcaggacactaggaccagtctgtgggatagaatgaacttaatgggggacggaagggggaggagtgctcaacggggagggaaatgatctatgactccaaccgtatgattttcttgcctccccagttttcatcccagtggtaacgcctgatttttggtagctatgccatcttctgctgaggattaccattactgggtgtatcaccccagtacttccaaatgcctctcctctattgattcagttgttattgcagtgtctgcttcatccgtggaacttgaggctcagatgccccctgctctgtaaccctggggaatgtcagaggcaggtaataaaggttgtttaaacaataa

SEQ ID NO: 54 - DNA, 4953 bp, Homo sapiens
gcatccccttgattaaatgtttttcctcctatgcaatcaccattagctgtttggctcccattctgtattcttctgaagcagccctgcattgcaaatcaatatctttctgaaaagacagtgtgttgtgaattgccttgacagcatatgcacggttactttggctgcaatgctgctgcagagcccggttactctgccttcgtgggaactccacagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctagagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaagtctgttttgttacagagacatgcctctcagaaggtcaggaggttttgagtacctatccttgccacccatacaggaaatccaaagtttggtgtctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttcattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgt

SEQ ID NO: 55 - DNA, 1719 bp, Homo sapiens
ggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactcttttagataaacacgatgaggcaaaatcaggttcattcattcaacgatagtttctcaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgctaaaaaaaaaaaaaaaaa

SEQ ID NO: 56 - DNA, 1047 bp, Homo sapiens
ggggcggggcagtgcggcgcggctccggttcccggcggccctcgcggcaggtttcgggcttcaggacaattcgtgatggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcagagagagccaggtagagctccgggaacaaattgacaacctagccacagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattaaaaagggagccgtacagtttgtttgaagcacttcgtcttacccatttatgtaggggccccaggaaacctacacacagccagaatgaggttcccaaaggacttacattaattatggctcttgcttcctttcacaaatgagctgaggcctctacttttttttttaagctgcatacgtgaggcttaccttcttcaggactagttaaccagaggggcttcctttgtatgttacatgcctggttacatgggcctggacagcatgtcctctacctgtgacttctcattttcctgtttacactggggatttggagggggcaggcaaagtcaaagtgaatgacctctgtccacccacttttttattgcactggcttgaatacagtagcagtgttgatagaatcattttattcaataaatacttaaaatgatattctagtttactctggtaaaaaaaaaaaaa

SEQ ID NO: 57 - DNA, 1432 bp, Homo sapiens
ggggcgtgctcgcggctataaggggcggaggctgggcggcgttgctctgcgctctgcggctgacggcgcttttgtctccggtgagttttgtggcgggaagcttctgcgctggtgcttagtaaccgactttcctccggactcctgcacgacctgctcctacagccggcgatccactcccggctgttcccccggagggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggttgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatatttctaaaaaaaaaaaaaaaaaaaaa

SEQ ID NO: 58 - DNA, 2646 bp, Homo sapiens
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacggtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttat

SEQ ID NO: 59 - DNA, 6881 bp, Homo sapiens
aggtggagaagggcggggaggtgtagcgtggcgctcagtccgcctgctactcggtcccggcgctgggctgaggggaggggttgtcttaaaagtctctccttccccctgtaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttcttgttttgttttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccagcccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 60 - DNA, 3722 bp, Homo sapiens
gcgcgctgcctcccgctctaggacccggatttaaagagacaggcgctccaaccgtcgtgggctgcccgcggcctgtaatgagcaagttccgaggcctacggtgagcgccggagccggagaggcagctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggcaacatgcagactgcaaagccttccgctatgaaggtgggggagaagctggccacaaagtcttctccagtgaaagtaggggagaagcggaaagctgctgatgagacgctgtgccaaacaaaggtattgctggacatcttcactggggtgcggctttacttgccaccctccacaccagacttcagccgtctcagacgctactttgtggcattcgacggggacctggtacaggaatttgatatgacttcagccacgcacgtgctgggtagcagggacaagaaccctgcggcccagcaggtctccccagagtggatttgggcatgtatccggaaacggagactggtagctccctgctaggtttgctgtcttccctctccctcaggccatactctcctttaccatactactggactggactcaggctggaggcagatagacacagtatagggggaatgggcttgcttctcccaaacccaccagttctccactgtctcttctggaccaggaattagttgctgtgggtgccacagctgaagtcagtttgtcttgctggtttaaatagatctttcagagctgggtgctgggtttgccatctttttgttttctttgaaaagcagcttagttaccctttttataaataaaatatcttgcagttatctttgtcctttccccacctacacccccaataatttccctagagattaaggagtaaaggctgggctatggcagctctgtccacaaagccttctctcccatccttgcctgttcctttgtacttccaggctcattttaaagttgtatttaaaggactgccctcggaaatgcttctgtttagcggaacttgtattcagcctgacacgctttgccaggaacaaacctcatgtgaaagaaaacaaaatgaatttttttactttcttctc

SEQ ID NO: 61 - DNA, 1580 bp, Homo sapiens
gcgcgaggacctgcggggcggggcgggagagaaggctgccgggaccggccctagacactgagccgcggtgggatccccaccggctctgcgaggccctgcgagcgccagggaggcgccacgagggagccgggcagccgcgggccacttcaggggggcccgcctcgccgcccgggcggtcgagagatccttgggggcacatctcggggtgcggtgacccgcccggcgcatttcgggggtcggggcgcaattgccaggggacatctggagcccggccctgcttctgtcgggctccagggtacccctggatggctgcgctgtgccctcgccggccgcccgggcgccgcagcggctgagttcgccgggatcgccgggccgccgcccttgccacccgctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgcccgaggacatggaccaggcgctcgtggacctcggcgtgctctccgaccccggctcgggcctttacgatgctgactcggagctcgacgtctttgatgcgtacttggagtagggtctcgactgctgttcccctcttccctacacgatccgcaacccatgccctggaccagccgcccagatcatgccgccgcagctggttgggggcaccatctggacggggatggttccccaggaggagaccctcccctgcctccgaggcctacctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgtgagttgagccttcaggccagctgggtttagcccgaggctggtcttagatgcagcgactgtttcaggggtgactcagaagaaaaagaagctgaggaagctgttggggggctgagggtgggattctcgctccttcatttcaggttactcgttcttcagcaagttggcaaaacagacatcatgctggtgagtgccacgttactcccctggctggaaatgcttttctgaaagtatgagtgttgtgcctacttaattctgataaacctgtctaagcaatacttaggaggcttacttctttggattaaaaaaaaatgtatgcaactccaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 62 - DNA, 3390 bp, Homo sapiens
agaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgcttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaatatggttta

SEQ ID NO: 63 - DNA, 2140 bp, Homo sapiens
agggcgcgggagcggccgggtcagcccgcagacctgagtccggcccgcagcctcggggccccgcgggcgcagcggggcgggaggcggggcggcccggccgtgggcggagcggcggccgcggccgtgagcctgcccccaactcgccctcagccggctggccggcgcggccatggaggtctacatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcgattttccaaatgtggttattgaaggagtcctccatgggatattttaccctcatctacagcccaggtagaaatcctacatggctaaaagaagcagaagcaagtttcgaagtcacagtcaaggaaatcaatacctaccaatttaacctaaacgctatgatatataacagctctagctagtggtaaagtgcacagtcccagcttaattcagggcagggacatttccattagaatggtgctcttaaaaatagaaactgaaccggggcggtggtcaggctaaggccaagtgtttaagaagtagagtgtagctgccagcgtagaaacccatgaaaaggaggccacaggagattcctgggagcactgggtgtagcaaaacaaagccactctctgcttcagtcgcaccatttgctaattgaaaatcatatcctgaatcatactgagactgatcaactttggtagcttttttgttcagatcttatgacacactactcttctcaccgtgagattttctcagccagtgatagtacattctgaaatgctggcaccaggagacggccacagacacacactgctaaatgtgaagatggaactaaactggaaattaaattatactgacaatattatggcatttttaagatcatggcattttaatttacattagagtggagttgcatcatactcaggggttagcttccaaggtcagtacataggtaaaatgggctattaggatgatccttgaaagccctttagaagggtgccatgttggaaacctgtacatccacaacaagtagcttttcctcctatgttggaaaaaaagactgtttctttgtttgaagaccaagtgaagttgttggtgtttgtttaggggccattttgttaaaaaaaaaaaaaaaaaagcacataacttttaacactagaatcagcccgcaagatgcttgccccgctagtggcagatgtgaactgacaaggagtgaagcgcccacccagcggatggacagcacccacctgggtttactcaagggtgtgcattcattttaggtgggatcgccacaggatttcatgttattttccttacggcttccttttcactgacctcatttgttgagttaatgtaagttaaatgtgtttatgatataactccactgtacatcatcctttgagtagtaaaggataaaagcatatatactacctatatgtatgtgctgtatgtgggcatttcattgagatctaattaatagctagcctatttatggttattcgttttagtaagttctgtgggagcaaggtatttaaaatcaaaactaataactacatcatggtttttgattaggatctaaatattcaggttttaagcctgctgcaaacttttaaaatattatgatagattctgtactacatgtgggaaacaagcaagaactaaataatcaaatgttgtcaaccaaaagtaatagttgggtattggagatttttttaaaatgtttttatgttattagctatttggagttaaataaaaacagaacaaggaaacaaaa

SEQ ID NO: 64 - DNA, 882 bp, Homo sapiens
gggagcggggaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgattttcca

SEQ ID NO: 65 - DNA, 3252 bp, Homo sapiens
ctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcaaaa

SEQ ID NO: 66 - DNA, 2377 bp, Homo sapiens
gtacgcacaggctgctgggatgccgcttttcccttctcggtcttccagtttcccggcgtgcttagggcgcgccaaatgggagggggagacgcaagatggcggcagccgcgaactccggctctagcctcccgctgttcgactgcccaacctgggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtcatttgggtgcaggctgtgaatttgtctctcagtcactgattgccactgccatctggaaatgtttgctaaaggcacagtcactgggcttgggaggcaatgctccatccccattatattacaaataaagatgccctaaatgagtgtg

SEQ ID NO: 67 - DNA, 651 bp, Homo sapiens
gacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacaggaaaaaaaaaaaaaaaaaaaaaaaaaaaaaa

SEQ ID NO: 68 - DNA, 2312 bp, Homo sapiens
agacagcgtggggtggggagggtcctcggggtccttggcagggcacgtgcgggaggaagtggagctccctgtacgcgcggccctagtcggctcctcaacgtggagcgatgggaggccttgagaagaagaagtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgcaaaaaaaaaaaaaaaaaa

SEQ ID NO: 69 - DNA, 1278 bp, Homo sapiens
gctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaaaaaaaaaaaaaaaaaa

SEQ ID NO: 70 - DNA, 9186 bp, Homo sapiens
gcgcgccccggcgccgcgcccggccgggagccgcctgttgatcgccgcgctcgccccggccacggcgccgcccctgttctcccggccccgctccaccggggctgacggactgacggccagcacagccggctccgggatgagcgcacggacggtattctgaagtctcaggaaactggaccatttaaatgtgcatggcccatgagaaaggcttataagaagccatggcactcccctttcaaaaagagctggagaaatacaagaacattgatgaagatgagcttcttggcaaactctcagaagaggaactgaaacagttggaaaatgttctagatgacctagatcctgagagtgccatgctgccagctggatttcgacagaaagaccagacacagaaggcagccaccggcccctttgaccgcgagcacctcctcatgtacctggagaaggaggctttggaacagaaagacagagaggactttgtgcccttcactggagaaaagaaagggagagtctttatccctaaagaaaagcctatagaaactcgtaaagaagaaaaagtgacccttgacccagaactggaagaagctttggccagtgcctctgacaccgaactctatgatcttgcagctgtccttggagtacacaatttgctcaacaatccaaagttcgatgaagaaacagccaacaataaaggtggcaaaggacctgtcagaaatgttgtcaaaggtgaaaaagtaaagccagtatttgaggaaccaccaaatcccacaaatgtggaaataagcctgcagcagatgaaagccaatgatcctagcttgcaagaagtcaacctcaacaacattaagaacattccaattccaaccctgagggaatttgcaaaggctctggagaccaacactcacgtgaagaagttcagcctggccgcaactcgcagcaatgaccctgtggccattgcttttgcagacatgctgaaagtaaacaagaccttgacaagtctaaacatagaatccaattttatcactggaactgggatcctggccctggtagaggcactgaaagaaaatgacaccttgacagaaatcaagattgacaaccagaggcagcagttgggaacagctgtagagatggaaattgcccagatgctggaggagaattcaaggatcctcaagtttggataccagtttaccaagcaagggccacgaacaagggtggcagctgccatcacaaagaataatgacctggttcgtaagaagagagttgaagcagaccgaaggtaaacttccttgaggagaagtgaagtttcactgtggtatggccattgaaaaacaaaaactcttcttcttccccatcaggaccattttatcaaagttcgttcatttccgttaaccacataactaataatttaattgttattcttttttagcactacttatttatcttggattttgtaatatatgcaattgttttatttgctcatgggcacttctggcaacttgacaaatggaccgatgcagattttagagagtgacgacatggaaaatgaatttaaccactttcttattgggttgtcttgctttcttacatgaacttgtttttttaatcactgaaaggaatttagtgtataatatgtgtttgtaactgtgattatgatagaggcctatctctgtttacatgcatagctttgagttaggctaaatacatcagaagtgttctactgaccacataagaagttagtattgccaatctttcactgcatgtgaaaatgtgaccaatttagcacaaattctctcttagttccagaaaaatcagtaaatgcacatgccctgttgattggagatcagtagtgtcatcttcataaagcaagacaacattatgacactttaaaacagtagcaaagaagtctatttattaacccacaaatgtagcatcaagccagactcacaggtagcaaaatgaattacacacctacttttactgactattcaacataaattgaatctttaacatgactttaaaggctatttacaaagctgttttaaagtttttcaaacatgatagaaattttctaaattttagtaagagagaagcttttaaaacagtacattcctgaataaaacaacaatattgtatcttaatcaaggctgtctgatgcagatgattgcattttttggcaaattttagaagcatttattgctttgtctttagtgtaacaagatcactggattaaatataaacattcaggttaattatctagatttttgtccacagtatatgatccatccagacatttgcaaacgtcaggagaaaaatgtgaattatttatccagatgcatgtcatctcaaggacaaagcctgtgaaagtacaagtgagatggttgcattgtagtatgcattaatctttcaatgtagtggtgtaaaaatgcagtgctaaactaatgaagcaggtgactgcagcctttggctcaagctcacaactctgataactgtcagtgcctgaggttgtgattggtgacattctgacactgcccaaggcaactcaccctctattcctcctttctcccctccctttcttccaattcattgtcttttttttcctcttttctctgtaatttgttactaaacaaattccagaatttgtttagtagctgagtgttcctgagttgcctagtagcaataaaacaagtgaataggaaaataattaatatattattctatttagcttgtaaaacacatggaatctgtttaagatagcccttgtaaaattgaacatttacctgtattgtaagtacccacatctgtgtctctgaagtcctttgaaacatctcattatcttgaaatttttttaatgtttgagaacaccataagcagaatattctaacacctttggcccctgaaaatcctttaattagtttatggcttcatctccttatctatttaaaaaacatagtaaataatgtttatggttttcagtctgatttttccttccctttcacccatttaggtgtgatgtgttggagtcaacttgtacaggcttgccaactgttatattttcaagaattttgcaaactggttgttcaatacagccattatttaaaattaaatgatgtgcacttacaactgaatgaattatattaaggacagaagtaacaaatactgtactcaaaaatcttacattttactattttctaacctcttagattatttacatctagtaggtatgtatgtagaaatattaccaaacagtatgctactgaacgtatcctctcaactccatgttcactaccttcttgttactacagtggcttgaaattggccatggtagaaatatttacaccacagaaattagcaatatgtaagaaattggggttttctccctctccagattgctggttgataaacattcatcagcacaccactgggtgaaattatacatttttttatacatatgtttcgcttatcatgttgccgaagggaagaacatttctcttagatgtcttttctcctctttggatttgttacaaacctgtttaagtgctgagtccctgacctgcctctccaagtaagcctttttcctttttttttttttttttcttactctcattcttgccttgactcttaaaatcctggaccctatagagcattccttgcagccccacagtgctgtgggctgggggctaaagcagttcttggcaaactctggcagaaagcaagaaaaaaagaatcagaattcaatcatggctgtttcttttgtacaagcagttgttgatagtattaaagcaagataatgggacattatcaaaaatatagcactgtttttaccttatgaaatagttgggttgcatgcaacagagtctatgaaatcaaatgttttttactaatcagtttgttttcttattacctgtgtttttaaagtggcttgaaaggtggcatttccatgagtgtgcacatattgatgataacccttagaaaaacatacacttgaggagcctatccatcatttaattagcctaggacttcatctccctctctgcccaaagtgtggaagtggtagctctttcatgatcatgggcacagttaatcctttgctatccattgtgatggggcataatgtatataaaatatttttctatgtatttgttctgccagatactgtgttgagatatttggcaatatctggataactgactgaagggagataacttctccccaggcctatctccctcccccttttagagttgtgcaggtccactttaagtgtaaaatcactcacctggacttgtgggcttgtatcaccaacatctattatggcacatgtagatgacatttaggagaaaaaccttagaagtctagaaatcatatgattagttcagcactgcagctccccatctgcttatagtgtataactggaagctctttcatcctcatcagcatgattaaatgacttcgtttctttcatctttggagggtataatgtaaataagtgtcgtgtgtgtatgtgtgtgtgtactgtcagatatctaactaggtatttggctacatctggacaactgattgaagggagatgctctctccccagtcctcttcccttgtcctttttagaattgctgcaggcccaggttaaatatgaaattactccctaggctttgcagtttatgttaccaaccaccacattttatagctatgtagaggatgactcttaggaaataaatattagaagcctagaaatcatttagttgttctagcaccaaatctatccatttgcctaatgtatttaacattccatcctcatcaacatgatgaagcccctttcttccatctttgtagggcacattgtatataaatattttgtacataaagatcatcaaataccataatggggtatttggcttcatctggaaaattgactggagggagatgctgtctcccagccctgcttccctcgtccctgtccaagttgctgcaggcccaggttagaagattaccaacctggaggggcatgcagttcatcttacaataaaagcccattcatttaaaaactcagaaatcatcccagtgcctgtactcctcaaaccaatttccctaagggaagactggcacaccagcccaaagagcaggtgcttctcttccaacagaaacatggcccctgacagggcaccagcattagggaaaccaatgtcctccgaatagctgccatgagaacatttcagatgctcaaactgaaaattcttaaaaccaatattaagcatcagcatgctttaagtgtaagatagccctttggaatttacaaacacatgtgcagctatttccttcttcacagatatgatgtactcagccccctcctaggcactacgaagaagacagaggaagcataaaaattctggactaatataattttatatgtgtttctgagattggggagtagactgagtgccttttttacaaagaagatcccatatttaattcaagtatttatagcatcagcaaaaatgggcagagggcgggaagttgagaacactaggttctgtgctatgttacctgtattcagtagaagtgtttctggagtcaggttttaagtcatgatcctgaagcttccttcccctcttccactaatgatgcaataatagctgttttcattttaacgagcagagaactaagaggaaaggtcctagctctgccttccacttgcagcttccctttacctcctcttattgctttcatctcaaatatccctgctactcaaccaatcctaaagctaaagtactgagatgcacacaaaggaaaggtgtgagagtgcttggaagcatccagctgagcccactggatgaaaatcagacgatagggcctcctgttgtaatatactagccagagaaaagcgccaagaacttcagggatattattcactgctttattgctccctaaccctagatcagattggattttactttgtagttcaggagttaagaagtcaaattgctgaccgaggtggggaaggatgatggaaattaaaggtttacatttgtttaatggcagaactgagatttgctcagcttatctctttcccatctgtctgtaatagcaatgactgaataatcagtagaccaatggaagaggagttgcaagtttaaatttgtaacctgactctgggttctgttctaggaatagtgcatgttttagaggctttgccagttgggatacattgttgacttgggggaggatgaaggagagaactgatgacctagacatagaaaagagtagttaactaactagatgttcttctgatctcttccatggtagacattctgagcacattggcccagttagttggtatggtgaaggggcaccgtactaacagatttggagactgaaacctaatcccatcaccaacacttagcaggtatatgatcatgggcaattcattcaattgcctgccaattatagactatatagggggaagagcactggatttggagtcaagaaacctggacacttggctccacacttccttagctgggtaactttgggcaaaccgcttggtctctcaagcctaaggttcttcagctataaaatgggaataatacttcactaactacctcacagagttgtggtaagaatataatcagataactggataaaaacactatataaactggaaagcgccgtacaaatgtgagagatcagttttattatcaaatcactgttttccactgcctcttgaatcggctttattctaaccaaccattacatctttctcatcttttggagtatgggtaattgaggcttgggtgtgtcatcagggactggagttatttcagctcccatgtagaggtgggagaggtggttgatggggcagtggaagttagataccagcgatgtatatggtaggacattttcctgggtcactttgacagtaccttgggaaattgtcagtccttgcagagggcctaggctgggcacaagggagaaagcgaacagttgactaagaattgaggggagggtctggagcgctactgccctcctgtcattgctgtgggtgggagaggctaagacttcaggtttgactggaggcctaggagagaagagtgtccttagggtttcaagaattttaatgcctagcagctgagtaacaggcattagttctgatagatagtgaaggggagaaagtgccacctgttgtgagatcacctctccagggcagcagctgccttgttatcaccagcaaccttagccctggtcagtaatatttctgctaagaaaggttttgaagcatggcctccaatgactttcataagcccttggaggcaggactgtgtctcatccatctttgtatcttcagtaccatcttgtaaggtgccttgtacatagtaggtgcttaatgaacaaatgttgcttgaatttagctgtcgtccagccccacagagttatgctccatttgccaccatgtgatatttttgagaaacaatagtgatttggatgccagctctatgtgactttgggcaagactctccatctatcttgtcttcatttcatctgtaaaatgaagtgagtagattcaatgctccctaaggtcccttccagctccaatacttgacaagcttgtgattctaaatcgtttccgttgcctctgaacatgggtgagtaatgcctccactgcagctgtttctctccaggaggctttgttcagaggaggtctgactattgcacagccagttttttcttcctcttcagcagttctttactgtcttcagaatggttctggataagcggccttttctgaaaggatatttaaaaatatatactatttaggctgggcccagtggctcatgcctgtaatcccagcactttgggaggtgaaggtgggtggatcacctgaggtcaggagttcaagaccagcctggccaacatggtgaaaccccgtctctactaaaaatacagaaattagctgggccctgtggcaagagcctgttatcccagctactggggaggctgaggcaggaaaatcgcttgaacccaggaggtggaggttgtagtgagccgagatcacaccactgcactccagcctgggtgacaagaacgaaactccatctcaaaaaataaaataaaatatatactatcttgctcctcagaaccagtggggaagaagagggaaggcaaagaaagaaactgagcatagtaaacacagcatttttttgtaggctcttatttaaaatgtgtgtgtgtgtgtgtatgtgtgtgtttctgagtaagtattgactgggaaaaagagagaagtcaatcaaaagtatactgtgcaattgagagaggctggcccaagatttaaaacttcctgtgggtaatctaactgtgagtagataggaatcggccatatgacgaaatgagatcaataggaaatgtgctttttgaggaaattttattttagtaccaaatgttgccagtgacaatcttcagttaagaagtaagttattctgacctaaaattcttatctctgccactttggtttaaaaacaaaaacccttatatacatggaatagttatattttaattaagcatttattttagttgttttcatccattcaagcaaaatgaataagcagcatttttcattgcacttaaaaatgtaaaatacctgcatgccactaatctgtaacattttaccagttcagatgcctgtaatgtgtgactttatgtgtgtctgtgttgttttgaagagaataaaggaaataatactttgcaaactgtttaaacaagtgtttaaacttctattggcaacatttattgggctaagcagttattgaaaactccgcatagttttattttccatttgaaacttcaatcaaatcaagactattatattcattagggaattaaagactaatttgctttttaaatgtgaagttgaacactgtgtggaaagtaaatgtgtgatgaagcaaaatgtataaagtatgaaatattatacttttaccctggataattattcaggaccccagttggcccaaataggtgcaatttttaatcctttgaaattagccagccagacctaatgctaaggtaaatgtaaactgttttaattaattaagatctttctgctttcgaaggtataatgtatctatttctgtcaggaatgatatttccaaatgaaaatgtaaagaacattgggaaataataaactttcctttcaaagtaaaa

SEQ ID NO: 71 - DNA, 1440 bp, Homo sapiens
gcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcaggtgggacccacatggaggcctgcagaacctgagctgtgaactggcaaccctggctctggggccgagtcaccttgcacaaggaggacagtggtatggccttggccccagaccactggtctggggcagaagcccacctgtcttgcagcccgtcctgcaaccagcccttttgaagagcagcttctgtgttcctcccctctctgagcagaactgatgctcctcagagtagtgggctggcgtccaaggatttgagccctgtcgagctcacggcaacctgggatggccgccggttgccaaggcgcctctctgcagtcgggctggtaggagggagtgtctggaggccattgctgcctccctcaacccccggggtcaactgtacccagcctagagccaagaaatccttcctttttattcattaaaacaaaatcaacctgatgcatacagaaaaaaaaaaaaaaaa

SEQ ID NO: 72 - DNA, 2707 bp, Homo sapiens
ggtccttgcggccactgcggccactgaagcggcggcggcggctggcccaggaggaagaagtcgagcccaagctatttccggttccggtgtcagttcgaggcgccgccgccgccgccgcagccgccggagccgcaatgcctaaaggaggaagaaagggaggccacaaaggccgggcgaggcagtatacaagccctgaggagatcgacgcgcagctgcaggctgagaagcagaaggccagggaagaagaggagcaaaaagaaggtggagatggggctgcaggtgaccccaaaaaggagaagaaatctctagactcagatgagagtgaggatgaagaagatgactaccagcaaaagcgcaaaggcgttgaagggctcatcgacatcgagaaccccaaccgggtggcacagacaaccaaaaaggtcacacaactggatctggacgggccaaaggagctttcgaggagagaacgagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaatctttgttttggcaatccatcctttggcttccgtgctcgagccgtttttacccagctgggtacggtgccacgttcaggcacgtgcacccggcaaggttcagggcacatacctacctggggcatgacatctgtcaggtggcaccgagcaggatgcggggatggaccctagataccacagcctgccccctcccctcctttagccaagtcaggatcttaggcctcagcaggcagggacccttccaggccacagtaggctgaagcagcaccaggatcctggcctggcctggcctgtaggtgtcccctggtggttataattctgtaactctaggggagaaggggaatagcactagcattggatgtcgccaaggcccacattttcctgagagaagccacaaaagatgtgcaaatgcccttcagcacaggacctggtgacatgacataaactccaagacagaacctcagtttacagcacacgaaaaaaatatcttgccaacattgtaatgacaaaataaattcccgtgaagttccacaaccaggccgggcatggtggctcatgcctgtaatcccagcactttgggaggtgaggtgggtggatcatctgaggtcaggagttcaagaccagcctggccaacatggagaaactccgtctctactaaaaatacaaaaattaaccaggcttggtggtgtatgcctgtaatcccagctacttgggaggctgaggcaggagaatcgcttgatcccaggaaggcagaggtggcagtgagctgagaacgcacaactgcactccagcctgggtgacgagcaaaactccatctcaaaacaaaagttccacaaccagcctggagtgtgtagcccctttgtccaggaatttgactagtcaatcagtgacacctggtactggcagttttgggagtggcagcccaggatggacagcagtggggagggaaccatttggcataaggccgttgggcttcaggatcaattttgttggcaagcagtaaaaataagctatctacctatggccgtgcaaacaccaatctctccctggagtcccagctacttgggaggctgaggcagaaggattgctcccacgagttctagtgcagcctggaaaacttagcaagaccccaaggaaataacaaaaaacctctccttccacataggcaagcatgtccataattacttttttttttttttttttttttacacagttgcattttattacctccacattttgaagcagttcatgaccagcatagtgctttgggggcattttttttttttttcaataaatgaaagcatttaagaaaaaaaaaaaaaaaaaaaaaaa

SEQ ID NO: 73 - DNA, 4373 bp, Homo sapiens
ttttggcgtagattccccactgatcgaggcattttttttccctttttttttcctttttttttttcttttaaaaattttggccatcgttctccgtacgggggctttttctgtctgtctgtctggctggcaggctggctttccccctctttcccacggagcccgagccgggcgcccggtggggagtggggagtgggtggggggagccagcagagttccattttggaacgcccgtgccgcgtctccgcgttcccagcccgggtccccgcgttcacagccccagcgcaggtctggatgtaccgactgcttttggaataaaaagattcccaggatgtgagcaacacgggaccgatatgatgcttcctggtgtgtttagtggttggtgccattccaattttctgtgctgaaatcattctgaaaactcaaacagtagacttcagcacacaaggaaagccaaagccatttgagggggaataaagccaaaagcctttcaccttattcgttccaagaatctcaccgccccctccttatccccctccaaaaataagccattgcacacagacaggcagcatggctagcaaacgaaaatctacaactccatgcatggttcggacatcacaagtagtagaacaagatgtgcccgaggaagtagacagggccaaagagaaaggaatcggcacaccacagcctgacgtggccaaggacagttgggcagcagaacttgaaaactcttccaaagaaaacgaagtgatagaggtgaaatctatgggggaaagccagtccaaaaaactccaaggtggttatgagtgcaaatactgcccctactccacgcaaaacctgaacgagttcacggagcatgtcgacatgcagcatcccaacgtgattctcaaccccctctacgtgtgtgcagaatgtaacttcacaaccaaaaagtacgactccctatccgaccacaactccaagttccatcccggggaggccaacttcaagctgaagttaattaaacgcaataatcaaactgtcttggaacagtccatcgaaaccaccaaccatgtcgtgtccatcaccaccagtggccctggaactggtgacagtgattctgggatctcggtgagtaaaacccccatcatgaagcctggaaaaccaaaagcggatgccaagaaggtgcccaagaagcccgaggagatcacccccgagaaccacgtggaagggaccgcccgcctggtgacagacacagctgagatcctctcgagactcggcggggtggagctcctccaagacacattaggacacgtcatgccttctgtacagctgccaccaaatatcaaccttgtgcccaaggtccctgtcccactaaatactaccaaatacaactctgccctggatacaaatgccacgatgatcaactctttcaacaagtttccttacccgacccaggctgagttgtcctggctgacagctgcctccaaacacccagaggagcacatcagaatctggtttgccacccagcgcttaaagcatggcatcagctggtccccagaagaggtggaggaggcccggaagaagatgttcaacggcaccatccagtcagtacccccgaccatcactgtgctgcccgcccagttggcccccacaaaggtgacgcagcccatcctccagacggctctaccgtgccagatcctcggccagactagcctggtgctgactcaggtgaccagcgggtcaacaaccgtctcttgctcccccatcacacttgccgtggcaggagtcaccaaccatggccagaagagacccttggtgactccccaagctgcccccgaacccaagcgtccacacatcgctcaggtgccagagcccccacccaaggtggccaaccccccgctcacaccagccagtgaccgcaagaagacaaaggagcagatagcacatctcaaggccagctttctccagagccagttccctgacgatgccgaggtttaccggctcatcgaggtgactggccttgccaggagcgagatcaagaagtggttcagtgaccaccgatatcggtgtcaaaggggcatcgtccacatcaccagcgaatcccttgccaaagaccagttggccatcgcggcctcccgacacggtcgcacgtatcatgcgtacccagactttgccccccagaagttcaaagagaaaacacagggtcaggttaaaatcttggaagacagctttttgaaaagttcttttcctacccaagcagaactggatcggctaagggtggagaccaagctgagcaggagagagatcgactcctggttctcggagaggcggaagcttcgagacagcatggaacaagctgtcttggattccatggggtctggcaaaaaaggccaagatgtgggagcccccaatggtgctctgtctcgactcgaccagctctccggtgcccagttaacaagttctctgcccagcccttcgccagcaattgcaaaaagtcaagaacaggttcatctcctgaggagcacgtttgcaagaacccagtggcctactccccaggagtacgaccagttagcggccaagactggcctggtccgaactgagattgtgcgttggttcaaggagaacagatgcttgctgaaaacgggaaccgtgaagtggatggagcagtaccagcaccagcccatggcagatgatcacggctacgatgccgtagcaaggaaagcaacaaaacccatggccgagagcccaaagaacgggggtgatgtggttccacaatattacaaggaccccaaaaagctctgcgaagaggacttggagaagttggtgaccagggtaaaagtaggcagcgagccagcaaaagactgtttgccagcaaagccctcagaggccacctcagaccggtcagagggcagcagccgggacggccagggtagcgacgagaacgaggagtcgagcgttgtggattacgtggaggtgacggtcggggaggaggatgcgatctcagatagatcagatagctggagtcaggctgcggcagaaggtgtgtcggaactggctgaatcagactccgactgcgtccctgcagaggctggccaggcctagacagggaagtctgttagaactgctgtgctgatcaacgggacgctccgtctttgaagaaagaagagatggtctctccccagccatgggccacccttgccagtgactccaagtggaactacttagctcgcgtgtgcctggagggtgcgggaagtccagcgactctcagacgcacctcccagaggaccggtgggaattgttcatagtgccaaagtcctactactgcgttttcaatgggtccttgtacatagtttgctcctctgccctagccctcacctcttgctatactggaaccgatttgtacaatgtgggaattttgttacctttttaatcaagggcaacttccttttccagcactaccattgtaaggtttttttcaggagggagggctaaccaccttgcttttctcttttctctttttcttttttttatttttgttttattaatttggggaaaggggtgttagcattagtgccatgatatctactggattttaagtagggagactttatttttaaaggtaggttgaaatttgggagatttctcggcaggaagggctgaaatccaggcccctgtctcaacttggagagaggtgacagacggcagatcttccaaatcaaattcctttccagttcttcccctggctgcctttttgggggtccctgccttagccccacacaaggctttctgaactgccaagaggggatctggcttctcaactgctcggcctcttgggccaggctgtgcccagccagccctgggagaactgggtagcaggtggctgacttctttaagcacctttctaaataccagcagaagaggctcccgcctctgttagcatgatcagtactattgtgacattaaaacaacaacaataagatcttcctatctggagggtacagaggtgaatggctttggttttcatttctcttcttcactgccttttctcggtgtggtatttgacaagattttagctcaaagcctcaccatgaattgattttttttgtttgtgtgtgtgtttgttttgggacaattttagatacctgagtgcactttttcagttagtcctaacttttaaaagaaggaaaaccaagagacatatctggtgtacgtgttgcagtatgaactctggttgcaatccctccccgtcccacactgccccccatttgagtacaccgcacaagtcaaacgctaggaagtttgaataaaaccaatttttctaacttgttgctcatttgttgtaactcaataaagcaaagactaaacatttttataacctttaaaaaaaaaaaaaa

SEQ ID NO: 74 - DNA, 4227 bp, Homo sapiens
cgcacgcgcgcgcgcggcggccccaggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtgtggaaggagcagttccgggtgaggtggccttcccttatgaaacactacagccccaccgactacgtcaattggttggaagagtataaagttcggcaaaaagctgggttagaagcgcggaagattgtagcctcgttctcaaagaggttcttttcagagcacgttccttgtaatggcttcagtgacattgagaaccttgaaggaccagagattttttttgaggatgaactggtgtgtatcctaaatatggaaggaagaaaagctttgacctggaaatactacgcaaaaaaaattctttactacctgcggcaacagaagatcttaaataatcttaaggcctttcttcagcagccagatgactatgagtcgtatcttgaaggtgctgtatatattgaccagtactgcaatcctctctccgacatcagcctcaaagacatccaggcccaaattgacagcatcgtggagcttgtttgcaaaacccttcggggcataaacagtcgccaccccagcttggccttcaaggcaggtgaatcatccatgataatggaaatagaactccagagccaggtgctggatgccatgaactatgtcctttacgaccaactgaagttcaaggggaatcgaatggattactataatgccctcaacttatatatgcatcaggttttgattcgcagaacaggaatcccaatcagcatgtctctgctctatttgacaattgctcggcagttgggagtcccactggagcctgtcaacttcccaagtcacttcttattaaggtggtgccaaggcgcagaaggggcgaccctggacatctttgactacatctacatagatgcttttgggaaaggcaagcagctgacagtgaaagaatgcgagtacttgatcggccagcacgtgactgcagcactgtatggggtggtcaatgtcaagaaggtgttacagagaatggtgggaaacctgttaagcctggggaagcgggaaggcatcgaccagtcataccagctcctgagagactcgctggatctctatctggcaatgtacccggaccaggtgcagcttctcctcctccaagccaggctttacttccacctgggaatctggccagagaaggtgcttgacatcctccagcacatccaaaccctagacccggggcagcacggggcggtgggctacctggtgcagcacactctagagcacattgagcgcaaaaaggaggaggtgggcgtagaggtgaagctgcgctccgatgagaagcacagagatgtctgctactccatcgggctcattatgaagcataagaggtatggctataactgtgtgatctacggctgggaccccacctgcatgatgggacacgagtggatccggaacatgaacgtccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttccgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccaaaaaaaaaaaaaaaa

SEQ ID NO: 75 - DNA, 3964 bp, Homo sapiens
gaaacgtacctaagtattattggacagccggagtattttacagtggttgctgctcaggaaatttgagtgaaggactgcaaaagaggagcaaagcagacccgagagagaaggcagcagtgctcccctgtgacgtgctccatcaccgggcagggaagacaccgctgccacctctccacagccttgttcaagagcactggaaattgatggtacaaaacagaagagggaacggaaaaagacagtctcattcagcagcatgccaacagagaagaagatcagcagtgcaagtgattgtattaattcaatggttgagggttcagaactcaaaaaggttcgctccaactctagaatttatcataggtactttttactggatgctgacatgcagagcctaaggtgggagccatctaagaaggattctgagaaagccaagattgacattaaatccatcaaggaagtgagaacaggaaaaaacacagacatattccgcagcaatggcatttctgaccagatatctgaagattgtgcgttttccgtcatatatggagagaattatgagtcactggatttggttgccaactccgcagatgttgcaaacatctgggttacaggactgcggtacctaatttcttatggaaaacatacacttgatatgttagaaagtagccaagataacatgaggacttcttgggtttcacaaatgtttagtgaaattgatgtagataaccttggacatataactctgtgtaatgctgtgcaatgtatcagaaacctcaatcctggtttaaaaacgagcaaaattgagcttaagttcaaagaattgcataaatcaaaggacaaagctggtaccgaggtcacaaaggaagaatttattgaggtttttcatgagctttgtactagacctgaaatttatttccttttagttcagttttcaagcaataaagaattccttgataccaaggaccttatgatgtttcttgaggcagaacagggtgtggcacatataaatgaggaaataagccttgaaattattcacaaatatgaaccatccaaagagggtcaggaaaagggctggctctccatagacgggttcactaattaccttatgtcacctgactgttatatattcgatccagaacataagaaggtctgtcaggatatgaagcaacctctgtctcattactttataaactcatctcataatacatacttaatagaggatcagttccgaggtccctccgacatcacaggatatattcgagctcttaaaatgggttgccggagtgttgaattagatgtatgggatgggccggacaatgaacctgtaatttacacaggccacaccatgacctctcagatagttttccgcagtgtcattgatattattaacaagtatgcattctttgcttcagagtatcctcttatcttgtgtttagaaaaccactgttccattaaacaacagaaggtaatggttcagcacatgaagaaacttttaggagacaagctctatacaacatcacccaatgttgaggaatcttatctaccatccccagatgtcctgaaagggaaaatactaattaaagcaaagaagctgtcctcaaattgctctggggtagaaggagatgttactgacgaagatgaaggagcagaaatgtctcagaggatgggaaaagagaacatggagcaacccaataatgtgcctgtgaagcgatttcagctttgtaaagaactgtctgaactggtcagcatctgcaaatcagttcagttcaaagaatttcaggtgtcgtttcaggttcagaagtactgggaagtctgttcctttaatgaagtgcttgccagcaagtacgccaatgaaaatccaggggactttgtaaattacaacaaacgttttcttgctagggtttttcccagtccaatgagaattgattccagtaacatgaatcctcaagatttttggaaatgtggttgccaaattgtagccatgaactttcagacaccaggactgatgatggacctgaatattggctggtttaggcagaacggaaactgtggctatgtcctccggccagccatcatgagggaggaggtctccttcttcagcgccaatacaaaagactctgtcccaggggtctcacctcaacttcttcacattaaaatcatcagtgggcagaactttcccaagcccaaaggatcaggtgccaaaggtgatgtggtagatccttatgtctatgttgaaatccatggaatccctgctgattgtgcagaacaaaggacaaaaacagtgcaccagaatggagacgctcccatttttgatgaaagctttgaatttcaaatcaacctgcctgaactggccatggtgcgctttgtagtgctggatgatgactacattggggatgaattcatcggccagtacacaattccctttgaatgtttacagacgggctaccgccatgtccccctgcagtccttaactggagaggtccttgcacatgcttctttatttgtccacgtggctattactaaccgaagaggaggaggaaagcctcataaaaggggcctttctgtgagaaaagggaagaaatccagggaatatgcatctttgagaacactgtggattaaaaccgtggatgaggtattcaagaatgcccagccccctatacgggatgccacagatctgagagaaaacatgcagaatgcggtggtgtcattcaaggagctgtgtggcctctcctctgtggccaatctcatgcagtgcatgttggcggtgtctccccgctttctggggcccgataacacacccctagtggtcctaaatctcagcgagcagtaccccacaatggagctgcagggaattgtgccggaggttctgaagaagatcgtaacaacttatgacatgatgattcagtccctcaaggcgttgattgaaaatgcagatgctgtatatgaaaagatcgtacattgtcagaaggcagccatggaattccatgaacacttgcacagcataggcaccaaggaaggtttgaaggaaagaaaactacaaaaagcagtggagagctttacctggaatattaccatcttaaagggacaagcagatcttttgaaatatgctaagaatgagacattggagaacctgaaacaaatccattttgctgctgtttcatgtggactgaataaaccaggcaccgaaaatgctgatgtccagaagccacgccggagcttggaagtcatacccgaaaaagcaaacgatgaaactggagaatgaggaaacttacaataaaccattatggagtttataactctaggaccaattgtagtcagatgggacatttgctttgcactcactaatgagaataatattcgggattttaaagcacaactggaatagctaattacagtctattaaaactgtgaatgtatgtagcaatcctgcgtgtgaaggcaaataaactctttaacaggcaattatattgctggccaaaatatgctatatttgtatacaaagacattctaactcagttccagtatgaagaaagattattcactctagctccactgagaaacattttcctaagtgaaaacaatttcttaagatggaaatggattggattgtcaaattattatttattggagaaaaaaacctgatctacacatttttacttatatggggttgccagagtctctgggttctagatgattttggtggcatgcttgctgagccataattactaaagagaatgtaagtggacgggttccctgaatccccggggtccttggagagccatcgaggagaatgtgcaattggactgaagctccctggctgaagatacatgccgagtcagcacatgggtagagatgatgtaaaagcagccaatctggaaacaatacattgtaaatagtttttcattgtatgaagtagtgttcacattaaaaagatgttttatgatatttctccaataaaaaaaaaaaa

SEQ ID NO: 76 - DNA, 2256 bp, Homo sapiens
cacgcggcaggcggtggcgggattctgccgcgtgcgctttcccgccccgcctcgcctagcctcgtcctgcgctcgccacgcctcgggctgtccgttgggccacgcagaccgcgctgcgctcgctccgtcgcggctccgcgtgccccaccttctggctagttttttctagagcccaggctccgcccgtttcccgcttccagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctcctgtggtttcaaattattaaacacacttccatttctcttggaagcatttcttttccttgctgttatagatgcaagcctgtgtctattttcatattactctgctttgtgcactttatggaggaggaagctagaggaaaaatggaaatgcagcttttaagttctttatgtgccacttagtgccttttaagattgattccatg

SEQ ID NO: 77 - DNA, 2172 bp, Homo sapiens
acccgcgcgccccgcccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggttcgcagagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataattacttgccacttgaatgtgttttgtgtaatgttttaacagtgctagtaaataaatacgggtttaccctggttttaattgtaaaaaaaaaaaaaaaaaaaaaaa

SEQ ID NO: 78 - DNA, 778 bp, Homo sapiens
atatagcagcggcggcggtggcggcggccacaccgggcggcggacacgtggagggacccggcccgcgccttctgcccctgctgccggccgcgccatgcggtgagcgccccaggccgccagagcccacccgacccggcccgacgcccggacctgccgcccagacccgccaccgcacccggaccccgacgctccgaacccgggcgcagccgcagctcaagatggcccgaggcagcgccctcctgctcgcctccctcctcctcgccgcggccctttctgcctctgcggggctctggtcgccggccaaggaaaaacgaggctggaccctgaacagcgcgggctacctgctgggcccacatgccgttggcaaccacaggtcattcagcgacaagaatggcctcaccagcaagcgggagctgcggcccgaagatgacatgaaaccaggaagctttgacaggtccatacctgaaaacaatatcatgcgcacaatcattgagtttctgtctttcttgcatctcaaagaggccggtgccctcgaccgcctcctggatctccccgccgcagcctcctcagaagacatcgagcggtcctgagagcctcctgggcatgtttgtctgtgtgctgtaacctgaagtcaaaccttaagataatggataatcttcggccaatttatgcagagtcagccattcctgttctctttgccttgatgttgtgttgttatcatttaagattttttttttttggtaattattttgagtggcaaaataaagaatagcaatta

SEQ ID NO: 79 - DNA, 600 bp, Homo sapiens
ggcaatgcgcatgcccagcgccgtatcgcgcacgcgctctctgcggctttccttgacctctgacccgccgaccacgcttgatccccggccgcggggccaggaagtcggagtttgagccccggaggcagagcggctgccatggccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgcaaaaaaaaaaaaaaaaa

SEQ ID NO: 80 - DNA, 6532 bp, Homo sapiens
gccggcccggaaggggctgatgcgaactggggccacggcagccatcgcgctttgcagttcggtctcctggtgtacggccaacgccaagtaggggattgcgttccctccagtcgcagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggcatccttgttgggcaaatgtttcatttaaatgtgtcttatctagctagtatactctgaaaatttgagtatttaatattaggcatatgaagtggttgttgggaaaggagattccttcagaatatttagaatagcgtttaaggctctcaaggcttaggtatttaccatgagatggttgtggtcagttgcacctgataccatgtatccctgaatcatgtgtatttttattagtaatgcagccactaccattgctgatggggtctgtgtcctagtccctgtgggattggccttctgaagaaaagcacatttatggtacacaaggttgattctcagtttggtaggctctatagttccatcccagctgtctaattctgaagtgctccagtcttattggtgcccaatggggtaatctgtgcctcttccccaaaagcaatgacaggcaccagtgtctccacatttagatatattcccagtctctgtacatttaacagtactctctggggcaagcaataagtaggaccttgtgtgcagtttcattgtagagacatgtatatctgaggaataaaacagcttgttctgtgtcagtctgagatatgtggagattttgttcctatcctatagctcttttgtattctttggcatattttatatcctggtagaagaaaacaagtgcttgtttccaattttcttttttcttatttgctctcaggtagttcttactccatacaacaaagactttttgtttgttgggctttttttttttttttttttttgctctgtttcattttgttttagagacggggtttcaccatgttgtccaggctggtctcaaactcctgacctcaagtgatctgcccgccttggcctcccaaagttctgggattataggcgtgagctaccatgcctgacctgacttttgtttttagatattatgcttgccatgtgatagggcctgcaagcctcattgctaggcttactaagaaaattttagtttttcaaaagcattataatttcctaagaaactgaattctttttttatatgtttgagattcccatcattagtaatataagatgaaaggtaagtgccaaaaatgtatttttaaagaccctcaagtttaagatttatcctgattataagccaagttttatagtatatttaaccaattccatcaagaataattttaatatcaaaaattagtgttttctgtagccattgtccatgtcagagttacagtcctttttgtcattgataatataacctatgaagcagataaggattgaggaatatgactggaaggaattactatttagctaagctgacaaggtcgcttcttaagatgacatttggtttcagtaatctgactattctgttttcactttcatcttctttctaaatgaaaacaaaagtgctccctcccttcctggaaacctcagtaacactatgggaaaagtagaacatgacattgcagcctattgatttcttcttccagataggtttaaagtactccttaagttctgactaaatagaactaagccttattaaaaataactgcctcttgttcatgttatctgtaccttcagggacctgcctttcttcaagtatttcctagagtatctattatgatactgaagaagctaattatttgtgttgtaaatgggtataaatgaaaaaaaaacatactggtttctctagccaggaaaaatgctttctggtgtaatatatcttgctccagaaccctcattctaattgtaacactaggatcaaagaaacaaagtcactttgtggaccacagctaaactgtggatattttcccaaagacataagatttttatggcccgagcctctagaaaggaagccatgtttaggagcaaccagctttcctcccagctttagggggcagagttcctgagccagaggacttactgtccagctttgagaacctctccagagtatatgcactgggtactgctctttttcaagagaaccaaattaagaggatggcaagaaacagtagaagcacagaggaaagacaactctgcatgtgcctgtgtgaatgtgtgcatccatggagtatttcccaggtaaatactagtactggggacataggctaattgtgtgtcccacactgcaagatgctagggcgtagttaacactgtggtatacatacaaatcaggcactgtccaaaagattttttaaaatctaaagtctgaaatgtaaaaatataaggtctcaacccacttttacacttttaaagagatcccatacctgtttcactgactgccgttaattacacttttggatcacagctggttaaattgatagatttcagtttatctcagtgaatttttagaatggagattatagcattttttaattggagaacagacatttcctaaagtatatgaaaaaaaattattcactgttggtttaaaccagtatctttgtatgagtgccaaagatatatgaacacagatactgcctgtgcagacctaaattttagttttgtgtacctggatccatatacaaattttttgtggtttatagcataaaagcagaacgttgtttctttcttagttttcaaccggctcatcttttgtttttgttttttgtttttttgttttttgttttttttgagatggagtcttgctttgttgcccaggctagagtgcagtggcacaatctctgcttactgcaacctccacctccggggttcaagtgattctcctgcctcagcctcctgagtagctgggactacaggcgcgcaccaccatgcccggctaatttttgtatttttagtagagatggggtttcactatgttggccaggctggtctcgaactcctgacctcgtgatctgcccacctcagcctcccaaagtgctgggattacaggcgtgagccgccatgcccggccaattttcaactggcccatactttatagtgatggaaagcgcataaactacttgtaaatcattaaaatagggtgataactgtgataatagtgtttcttgcattctagaaaattattttattaactacattcaaaacccagcatttcacaggttccatcattagaaacagtatagttctagttaacatgattggagagtttcaggggaaaggtttacattttctgaaactgtatttggtatgtgactcaatgtggtatttcagtcttgttagtcacttacatgactgacgtttgcaaggatttattgccaagtaaaatttgaccagagtgcactgagaatagctacataaggggaaatctctcaaaattccttctgttcatttaatttggagcatattgtttaaatcattttaaacatatgtaaaaagttgaagcattaaaaaatcttcaagaaacaatgaaaaaatagaaattagcaaacataagtttcttaatgcaaaattaatagtgaataaaatatagcctacattaaaagccagaggctttgctataaatataagagtttagaaaaacagtgtgcttcaattaaggactaaattatcaaaactgcatgtttgttttttcttttcttttcttttttttttgagatgaagtctcactctgttgcccaggctggagtgcagtggtgcgatcttggctcactgcaacctctgcttcccaggttcaagcgattctcgtgcctcaccatcccgagtagctgggattacaggtgcaccacaccatgcccagttaatttttgtatttttagtagagacagggtttcattatttggccaggctggtctcgagctcctgatcttaagtgatccactcgcctcggcctcccaaagtgctgggattatacacatgagccactgtgcccagcctaaaactacatgttgaagcttccggtcatttccattattatccttcttttgaaattcaagttagtgctttttaaccaaataaaagaagaaccagctcttgggatatgtgactctgcctctgtataaagtgactggaattttgttaaaaccgtgtttccacttctgaaccctgttaccattccccctcacaaatccccacccaacacctggattttaaagatcctccagtgtcaagggaagccacagagtctattaaagaggcagttctgaaccaattaatttttgtccttataatttagagcattaaatagctaatatatttaatggcactaattgttgttcacggctttcatcatacttttaaacagaatccaaagtattcaaaggaaagtaagcgaagttatccaaagccaactttgtttcaggtgtgtcccctgccccaaatagattttagggcagaaatagaaaactgagtttacacagaactatttttggaaaagctgcactggagtagatggattcttcttcagcatacttttttgtttgtttgtttgagatggagtcttgctttgtcacccaggctggagtgcagtggtgtgatctccactcactgcaacctccacctcccagcttcaagtgattctcctgcctcaaccttccaagtagcttggattacaggcgtgcgccaccacagctggctaatatttgtattgttagtagagacagggtttcaccatgttgtccaggcttgtcgaacttctgacctcacgtgatccacctgcctcagcctcccaaagtgctagattataggcgtgaaccactgcgcccggccagcatgcattttaaaagtggcttagatttagttttaaatattttggggtgaaaggcaggaacagttctgtttttgacatacaggttttctttgggattgttttcattttcaagtatagattcatgtcagaatggccaacttaacgtgggtttctgtattccctggtgttgctcttaacctgaactcataatcagttgccatactgaggcaagagcactcagggtgaacatagtcaagttactttaaaagtgataaaagtgtttttccatggtgaaaccttcagtatttggctgaatgtaaagtatgttgaagtggtatattgatggtaagttgttaatcactaaccttgtttgcacttttgtacaccactgcttgcactaggatcttggtgtgaattttcaattgttttacagtgtatacagattattaaggataatttatataaagatgtttctgtttaactttgtgtgttttacaacaaagagctataatagatggttaaacgtttttgaattgtgtttatatgttagtttgattatgttctattatcttttcacctgccatgaatttgagtgttaggaagggaaaaataaaatactaatctggtcttgaagaa

SEQ ID NO: 81 - DNA, 1602 bp, Homo sapiens
ggcttaggctgagccgtggccgccacagcccatcgtaatgccgcatggtgcttggcactccagagagccaataggaatgaaagaattcatttgaatcggccaatgccggcgggttagggggcgggggttgaaaaccctataaaggcgtcgatcggccggacaggcggcagcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 82 - DNA, 4379 bp, Homo sapiens
gctttccaccttccctccgggcgcgagcgcccgtggggcgggcctcagcggcggcgcgacaagtccagaggtgagggctgaggaaggggcgtggctagcgggctggcctcagccaccctcttccgggctccgccagctgcgcgcgcatcttctcccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaaattggttgcattattttctgaactataatagggtttttcttcaggtgaacaatttgacgtgtcatcagtttttattgcagcactgtccatattcattgtataaagagaggtctacgtatgtagcatataaaaccacatcactaagtaatagacccacagctttattcttgtgtttacattacccttgaaatgttttcagtcaacccttttcagtgtaagatcagcacatttggtggctgatgctgttctcctttgactgtaccgggagccagattctatcatatgcatgtgtaatcccctgtaatacactcaggtgctcacaaatagagcagattgtcatattgtaacatgcgtgtgccagacaccgggcagtacactttggaaagaatgtgaaatccttttaatttttaatccatagcttactgcttgtgcagtcacctgcctcttgaggttgctcattgcccttggacctgtgaggaggccttcagattagtaattggtgcttagtactatttatgcttaaatagatcttccagtacaatgttgaagtcttttttatggataataacgtgtttgatggagtaacttattatttttttttggttggtggtttacacgttaatagaggtagtacaatttctttggaaaggtgtcttttgaagccagctgttaagcttcatacattacctcccttctcaaattcggtaagacagtagttttggggaacttttttgcccatgtgtcttttaagtgtgattttaaaaaaatgagtggttcagttcattcccctaaacagaagaaaagaccaaataattaccttccattcctcttcatgtgggaatatagagagggttcatgtggcattttagagaaaagataatttatcctcattcaacacaggcccagaaaattgtgtcccagaaggatgtcagtaattgtgactaggccaggccttttagcattttgctaagacttgaaacaaaaaatgtaaatacaaaagaaatcaagttttgttttgaaagatgccttctagaacttactgtgtattaataaattgtcactttcattgtctttattgtaactccattgatcccgtatcttaacggttcacgtctagccaaataactgttttggaataaaaaccttggtggtgaaaaaaaaaaaaaaaaa

SEQ ID NO: 83 - DNA, 1182 bp, Homo sapiens
aatgagggcctccagggggcgggtcggactgccgcgggccggggagcgctctgggtggccagctgtgggcccgggccgtcgtgggctccggcttgcgtgcggagatgagcgggtccctcggccgagctgcggcggctctgctccgctgggggcgcggcgcgggcggcggtggcctttggggtccgggcgtgcgggcggcgggctcgggcgcgggcggcggcggctcggcggagcagttggacgcgctggtgaagaaggacaaggtggtggtcttcctcaaggggacgccggagcagccccagtgcggcttcagcaacgccgtggtgcagatcctgcggctgcacggcgtccgcgattacgcggcctacaacgtgctggacgacccggagctccgacaaggcattaaagactattccaactggcccaccatcccgcaagtgtacctcaatggcgagtttgtagggggctgtgacattcttctgcagatgcaccagaatggggacttggtggaagaactgaaaaagctggggatccactccgcccttttagatgaaaagaaagaccaagactccaagtgagggcggccaagtcctcgctgagcagagagggagccgttcatgtcagagactcactgccagaaaagccttacccattttggttttcactattgagaccgcaactgcttgcactgatcattttggttcgtgagcagttggtgattttagttggtctggtgttcgggctaagaatattttattgtggacttaattacaaccactgcactgtaatgattcaatgctgtattatgatattgctgtaaacaaaattcattcttatattgtcacttattctttgcctgattcagaagttaaataggagctttggaatcattattcatgacccctctgcaaatgtgtcagtctccaaagagagtatctccccccaaattttgtgtagcttcttttgttatggaaaatggtgaacaaaaaaagaaactgtgataactggggcgttgttttttaaaataaactccagcacagggatgctgtgcatgcctgagttgattccgaagtgcatatgtctgtaaggatttggagtgcctgcagtgttttatgtgtgggaagtaagggtgagtctcatattcttctattaaatttgccacaagaattgcaaaaaaaaaaa

SEQ ID NO: 84 - DNA, 1632 bp, Homo sapiens
ggaactacgcagagccagaccagcgggaccacagaatgggctgaggcggcggcggctgtttggataaagtcaacagcgggacgtggggcgtgacgccgtagtaaaagcccagcttgaaaatggagatgtatgaaacccttggaaaagtgggagagggaagttacggaacagtcatgaaatgtaaacataagaatactgggcagatagtggccattaagatattttatgagagaccagaacaatctgtcaacaaaattgcgatgagagaaataaagtttctaaagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaagatacttcttatggaaaacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatgcttgtttacaaattgatcctgctgacaggatatcatctagtgatcttttgcatcatgagtattttactagagatggatttattgaaaaattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggtgagctgtaacagagaagaaacctaaataatacaacattcctgtataatggtatttcaaagaatcgtgttcatagtgtctgtatgtaaactgaacttgaagaaaatatattgaaattaaagctgtataatgggccaaaaaaaaaaaaa

SEQ ID NO: 85 - DNA, 1815 bp, Homo sapiens
ggagtctcgcgccagctgagcggcggtcgggcggggggagcgcggcggcccaagctcgctcggccacgcgccccgccccctcagaggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactgaaaaaaaaaaaaaaaaaa

SEQ ID NO: 86 - DNA, 1019 bp, Homo sapiens
gagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagcaaaaaa

SEQ ID NO: 87 - DNA, 1634 bp, Homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattaaaaaaa

SEQ ID NO: 88 - DNA, 844 bp, Homo sapiens
aggttctgcgagcggcttccgccgggctgctccgcgggcgcgtcggccatgagcgagttgccgggcgacgtgcgggcgtttctgcgggagcacccgagcctgcggctccagacggacgcccgcaaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgcaccagttgttctgcaaactcaccctgcggcacatcaacaagtgcccagaacacgtgctgaggcacacccagggccggcggtaccagcgagctctgtgtaaatatgaagaatgtcagaagcaaggggtggagtacgtgcctgcctgcctggtgcaccggaggaggaggagggaggaccagatggacggtgacgggcctcgcccgcgggaagccttctgggagcccacatccagtgatgaggggggagctgcaagtgatgacagcatgacagacctgtacccacctgagctattcaccagaaaggaccttggaagcacggaggatggggatggcactgatgactttttgacagacaaagaggatgagaaggcaaagcccccaagagagaaggccactgatgagagcaggagagagacgaccgtgtaccgagggctggtccagaagcgcgggaagaagcagttgggctcgttgaaaaagaagttcaagagtcatcaccgcaaacccaagagcttcagctcctgtaaacagccaggttaataaaagcacatgccgtgaagtttcg

SEQ ID NO: 89 - DNA, 1944 bp, Homo sapiens
atttctgtgcgccgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagaagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaacaagaaaaaaaaaaaaaaa

SEQ ID NO: 90 - DNA, 4183 bp, Homo sapiens
gccccgtgtgcagctttcgcggcctgcgtctggagaaaaccctagcgggtggctccgtgcggccagagctctagagagtggtgccgccttccaaccttcttccccaagccctggtggccggctccgcctcttctcgaatcttttccacagcccaaaatggccgcagaggtgtattttggcgatctagagctcttcgagccgttcgaccacccagaggagtcgattccgaagcccgttcacactcgcttcaaggacgacgacggcgacgaggaggacgaaaatggggtcggcgacgcggagctacgggagcggcttcggcagtgcgaggagaccatcgagcagctccgcgccgagaatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgttgtaggaagtgtcctgtattttactaatttttgccttgataaattggggcaaccgcttctaaatgaaaaccctcagctttccgaaggatgggaaatacccaagtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacactcctccactcccccggggaactcctccacccgtcttcacccctccactcccaaagggcaccccgccgctgactcccagtgactcaccccagaccagaacagcatctggagctgtggatgaggacgcactgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtcgtaccaaactgtgacatcagcaatgggggcagccagaagctctttcctgcagacaccagtccttcaacggccactaaaattcatagccctatacctgacatgagcaaatttgcaactggaatcacgccatttgaatttgagaatatggcagaatctactggaatgtacctcaggataagaagcttgttaaagaactcaccccgaaaccagcagaaaaacaaaaaggcctctgaataatggcttgacttagcactgagagctatttaataactttgttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatatacataatctaagactttgaatacaaaaaagtgattcacaggtaaaatcagtgtatataaccttttttttttttgagacaagggtttcactcttgttgcccaggctggagtgcaatggcacaatctcggctcaccgcaacctccgcctcccgagtttaagcgattctcctgcctcagcctccggagtagctgggattacaggcatgtgccaccacgcccagctaacttcgtatttttagtagagatggggtttctccacgtcgggtcaggctggtcttgacctcctgacttcaggtgatctgcccgcccagcctcccaaagtgctgggattacaggcgtaagccacctcacctggccggtgcatataacttttaagtttaaaagtaaattgttggccaggcgtggtggctcatgcttataatcctagcactttgggaggccaaggaggaaggatcacctgaggtcaggagttcgagaccagcctggccaacatggcaaaaccccatctctacataaatacaaaaattagccaggtgtggtggtacatgcctgtaatcccagctactcgggaggctgaggcaggagaatcacttgaacctgggagtgggaggttgcagtgagccgaggtcgcgccattgcactccagcctgggcaacaagagcaaaactccatctcaaaaaaaaaaaaaaaaaaaggtaaattgtaaaaatcagtggtagcaaaacaaaaataatgataggaattgcaagtttgggtgttttcagtggatttcagccttaaatatagaaacagcagaatttttgaaaagtaattattttgaaaaatgaatggcatgcagctagcctttgtataaaaataattttctagatttgaaccctaatagttaaaaattaaaaattaaacataaacatactgcttttaattgtcaggtatatatataagatagagctgaaactgtggtttaggtctttctgtggaatgccattacatctttatattagtcaagtccatgaaaataaatgtttagatcgtcttgaattgttagtctcaggcagtgttatcctgctctcaggccaacagggggagcaaaatagaaacattccagatatagctttcatttttgagaacttgagtaatcagaatttactgttctgtaaagaataaaggaaaggaaaattataaagagagaaatttctttttaaagccctcacagaatgtgctagaaatagaataaaatttaaaatacttttggcttcttttcctcagcttaagttcaaaataaaagcaatcctttacagttgaaaaa

SEQ ID NO: 91 - DNA, 1924 bp, Homo sapiens
agacgaacccggaagtgagatgcaaggcggcgattttcccttctgtcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaagaaaaaaaaatggaaaaagacccaagcagattgcttctttgggctgctgaaaaaaatcggcttaccacagtgcggagactcctttctgaaaaggccactcacgtgaacactagggatgaagatgagtatacccctcttcatcgagcagcctacagtggacacttagatattgttcaggagctcattgcacagggggccgatgttcatgcagtgactgtggatggctggacgcccctgcacagtgcttgtaagtggaataataccagagtggcttctttcttactgcagcatgatgcagatatcaatgcccaaacaaaaggcctcttgacccccttgcatcttgctgctgggaacagagacagcaaggataccctagaactcctcctgatgaaccgttacgtcaaaccagggctgaaaaacaacttggaagaaactgcatttgatattgccaggaggacaagtatctatcactacctctttgaaattgtggaaggctgtacaaattcttcacctcagtcttaacaattctagtaattttcctaagtttctaaataccagtgcctcctgtgtgtgagatgtattcccataatcaaagttgacgtcaaacatcttactacaaaaattcagtgacattcattataacattcttccaagtgaattgcctgactttgatgtcaaaatgtatttgaaagtaatttgcatatatctttaattatttctgtggagtttgtgatttttttatcagaaataattttaatgtgtgtatacttaaaaacttgacacgggttgtacagaaactggtatttttggtgctgatacaagagaaatgtatttttaaatatcccacatcctggatctttgttgggtatttagtatattgacatatatttttataaggtgaggtaactcagaacttaatttaaaagtcttaaatattctgatacaattcagctgtcttctctaccttaccatagccagttgctttcattttaaaccagagcaagtaacatattagtgacttgaatcttcataagttaaagtaaaaaacagcaaaaaacctagatctttgtcttttagaacacagaccattttcaggaaagcagttagctaagtgtttaattcatgaatattgtatactgcatcccctaccacaatttacacaatcctgtggatagtcctacctcaccctggtcaacctacatgatccttaagctaatggcgaatcacgatgaccttgtagacatgcacacaactatacctttgtccaacagatcataatatatctgctatccaactggttttacctgcctaatcctactgatttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaaacactgtggataatgacaaaaagcataagtaaaaatatttgagaaaaataaagtacaagttttgaacaacaaaaaaaaaaaaaaaaaaaa

SEQ ID NO: 92 - DNA, 2005 bp, Homo sapiens
atttcctgccgtaagtatacagtgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaacagccctcatcttccttgattttatggttttattgtttgtaatttattgatttatttttaagctagttataatcatgtaggtataggaaataaagtcatctataatatttctataatatggctataatatggctataaatctataatatggctggaggcagtgggcagtggttcatgcctgtaatcccagcactttgggaggccgaagtgggaggattgcatgagtccaggagtttgagaccagcctgggcaacaaagcgagaccctgtctttacaaaaaaataaaaattagctggcgatggtgtcgtgtgcctgtagtcctagttacttaagaggctgagttgggaggatcagttgaacccagtggttctgggttgcagtgagctgtggtcacaccactgaactccagcctgtgcgactgagtgagaccctgtgtctaaaaaaataaaaatataatgaatgtgatttatgtagataaattgataatatagtaaataggtaaatgccttaaaaagcatttttaaagaatttgtaaattctaaaacaataaaaatttggtatacatcaca

SEQ ID NO: 93 - DNA, 2247 bp, Homo sapiens
taaatgtgccacgtcttctaagaagggggagtcctgaacttgtctgaagcccttgtccgtaagccttgaactacgttcttaaatctatgaagtcgagggacctttcgctgcttttgtagggacttctttccttgcttcagcaacatgaggcttttcttgtggaacgcggtcttgactctgttcgtcacttctttgattggggctttgatccctgaaccagaagtgaaaattgaagttctccagaagccattcatctgccatcgcaagaccaaaggaggggatttgatgttggtccactatgaaggctacttagaaaaggacggctccttatttcactccactcacaaacataacaatggtcagcccatttggtttaccctgggcatcctggaggctctcaaaggttgggaccagggcttgaaaggaatgtgtgtaggagagaagagaaagctcatcattcctcctgctctgggctatggaaaagaaggaaaaggtaaaattcccccagaaagtacactgatatttaatattgatctcctggagattcgaaatggaccaagatcccatgaatcattccaagaaatggatcttaatgatgactggaaactctctaaagatgaggttaaagcatatttaaagaaggagtttgaaaaacatggtgcggtggtgaatgaaagtcatcatgatgctttggtggaggatatttttgataaagaagatgaagacaaagatgggtttatatctgccagagaatttacatataaacacgatgagttatagagatacatctacccttttaatatagcactcatctttcaagagagggcagtcatctttaaagaacattttatttttatacaatgttctttcttgctttgttttttatttttatatattttttctgactcctatttaaagaaccccttaggtttctaagtacccatttctttctgataagttattgggaagaaaaagctaattggtctttgaatagaagacttctggacaatttttcactttcacagatatgaagctttgttttactttctcacttataaatttaaaatgttgcaactgggaatataccacgacatgagaccaggttatagcacaaattagcaccctatatttctgcttccctctattttctccaagttagaggtcaacatttgaaaagccttttgcaatagcccaaggcttgctattttcatgttataatgaaatagtttatgtgtaactggctctgagtctctgcttgaggaccagaggaaaatggttgttggacctgacttgttaatggctactgctttactaaggagatgtgcaatgctgaagttagaaacaaggttaatagccaggcatggtggctcatgcctgtaatcccagcactttgggaggctgaggcgggcggatcacctgaggttgggagttcgagaccagcctgaccaacacggagaaaccctatctctactaaaaatacaaaagtagccgggcgtggtgatgcgtgcctgtaatcccagctacccaggaaggctgaggcggcagaatcacttgaacccggaggcggaggttgcggtaagccgagatcacctccagcctggacactctgtctcgaaaaaaagaaaagaaacacggttaataacatataaatatgtatgcattgagacatgctacctaggacttaagctgatgaagcttggctcctagtgattggtggcctattatgataaataggacaaatcatttatgtgtgagtttctttgtaataaaatgtatcaatatgttatagatgaggtagaaagttatatttatattcaatatttacttcttaaggctagcggaatatccttcctggttctttaatgggtagtctatagtatattatactacaataacattgtatcataagataaagtagtaaaccagtctacattttcccatttctgtctcatcaaaaactgaagttagctgggtgtggtggctcatgcctgtaatcccagcactttgggggccaaggagggtggatcacttgagatcaggagttcaagaccagcctggccaacatggtgaaaccttgtctctactaaaaatacaaaaattagccaggcgtggtggtgcacacctgtagtcccagctactcgggaggctgagacaggagatttgcttgaacccgggaggcggaggttgcagtgagccaagattgtgccactgcactccagcctgggtgacagagcaagactccatctc

SEQ ID NO: 94 - DNA, 2014 bp, Homo sapiens
agcggagagcgggcggccgtgcgggcggcggcggcggcacccccaggccgagccggcgcggaaggagttccagggcgatggggccgcggccggggctgacgctttgacagctggaaagagcgcggagccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttaca

SEQ ID NO: 95 - DNA, 5582 bp, Homo sapiens
ggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttggggattgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaacattaaaaaaaaaaaaaaaaaaaaaaaaaaaa

SEQ ID NO: 96 - DNA, 3244 bp, Homo sapiens
gggcggggctgcggttgcggtgcctgcgcccgcggcggcggaggcgcaggcggtggcgagtggatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaatgccatcagctcacacttgcaaacctgtggctgttccgttgtagtaggtagcagtgcagagaaagtaaataagatagtcagaacattatgcctttttctgactccagcagagagaaaatgctccaggttatgtgaagcagaatcatcatttaaatatgagtcagggctctttgtacaaggcctgctaaaggattcaactggaagctttgtgctgcctttccggcaagtcatgtatgctccatatcccaccacacacatagatgtggatgtcaatactgtgaagcagatgccaccctgtcatgaacatatttataatcagcgtagatacatgagatccgagctgacagccttctggagagccacttcagaagaagacatggctcaggatacgatcatctacactgacgaaagctttactcctgatttgaatatttttcaagatgtcttacacagagacactctagtgaaagccttcctggatcaggtctttcagctgaaacctggcttatctctcagaagtactttccttgcacagtttctacttgtccttcacagaaaagccttgacactaataaaatatatagaagacgatacgcagaagggaaaaaagccctttaaatctcttcggaacctgaagatagaccttgatttaacagcagagggcgatcttaacataataatggctctggctgagaaaattaaaccaggcctacactcttttatctttggaagacctttctacactagtgtgcaagaacgagatgttctaatgactttttaaatgtgtaacttaataagcctattccatcacaatcatgatcgctggtaaagtagctcagtggtgtggggaaacgttcccctggatcatactccagaattctgctctcagcaattgcagttaagtaagttacactacagttctcacaagagcctgtgaggggatgtcaggtgcatcattacattgggtgtctcttttcctagatttatgcttttgggatacagacctatgtttacaatataataaatattattgctatcttttaaagatataataataggatgtaaacttgaccacaactactgtttttttgaaatacatgattcatggtttacatgtgtcaaggtgaaatctgagttggcttttacagatagttgactttctatcttttggcattctttggtgtgtagaattactgtaatacttctgcaatcaactgaaaactagagcctttaaatgatttcaattccacagaaagaaagtgagcttgaacataggatgagctttagaaagaaaattgatcaagcagatgtttaattggaattgattattagatcctactttgtggatttagtccctgggattcagtctgtagaaatgtctaatagttctctatagtccttgttcctggtgaaccacagttagggtgttttgtttattttattgttcttgctattgttgatattctatgtagttgagctctgtaaaaggaaattgtattttatgttttagtaattgttgccaactttttaaattaattttcattatttttgagccaaattgaaatgtgcacctcctgtgccttttttctccttagaaaatctaattacttggaacaagttcagatttcactggtcagtcattttcatcttgttttcttcttgctaagtcttaccatgtacctgctttggcaatcattgcaactctgagattataaaatgccttagagaatatactaactaataagatctttttttcagaaacagaaaatagttccttgagtacttccttcttgcatttctgcctatgtttttgaagttgttgctgtttgcctgcaataggctataaggaatagcaggagaaattttactgaagtgctgttttcctaggtgctactttggcagagctaagttatcttttgttttcttaatgcgtttggaccattttgctggctataaaataactgattaatataattctaacacaatgttgacattgtagttacacaaacacaaataaatattttatttaaaattctggaagtaatataaaagggaaaatatatttataagaaagggataaaggtaatagagcccttctgccccccacccaccaaatttacacaacaaaatgacatgttcgaatgtgaaaggtcataatagctttcccatcatgaatcagaaagatgtggacagcttgatgttttagacaaccactgaactagatgactgttgtactgtagctcagtcatttaaaaaatatataaatactaccttgtagtgtcccatactgtgttttttacatggtagattcttatttaagtgctaactggttattttctttggctggtttattgtactgttatacagaatgtaagttgtacagtgaaataagttattaaagcatgtgtaaacattgttatatatcttttctcctaaatggagaattttgaataaaatatatttgaaattttg

SEQ ID NO: 97 - DNA, 3337 bp, Homo sapiens
ggccgccatggcggatgcggagccggaggctgggggcggcagcgaggatggcggcggcggcggcggcccggctcctccgggccagagcggcagcgtcgcacgtgtggccccgctgggccccgagcagctgcggcaggtcctggagcaggtgacgaaggcgcagccgccgccgccgccgccccccttcgtgctgcgggacgcggcgcggcggctgcgggacgcggcccaacaggccgccctgcagcggggccggggcaccgagcccccgcgcctgccgcgcctgctcccgccccagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgccctgctgtctacatttttctatggagcttgtcataataatagcagatattacctgatcaggaatccctgtggcgcgtctgacgctcatgagtttttcatgatggtgatgagtagcactgcactgtcacctgatgattggccctgctccgtttcccttctctcctgggagatatgctgcttttccaccagacttgctccatactagaagcttcttttgggttcaattaaaaagaaaataagctagtcattctgggcagcattttattgatagaagggggaaaaagtcatttctacttgcatgattttttaaattaaattaaattaaattaatttaattattaaaaaaaaaaaaaaaaaa

SEQ ID NO: 98 - DNA, 2817 bp, Homo sapiens
atgttttccacctctccctgaggaaacacggcgccgcccagctgcgagtcaccgcttactgaaccccttcggcaagcaggggaaagaccctcccgcctttccgtacgaagacatggcgctgccctatattgggctggcgcctcccggccaagagcagtctcctccttcctgatgctgagaagcggccgctctgaccgctgcccacccgagtcgggctgggaggaccgcccgccgcgtggcgagggatgcggcctcggaggggcagaggctgaaccgcccctgcctgccgcgcatccctccggcttccgccgcggcgccagcccgcgcctgattcgcggcgggagcggcaggagggagaacgccgactccgtggcaggaaagtgaataaacttaattgagaatgtctgaaaaccttgacaagtccaatgtaaatgaagcaggaaaatcaaaatccaatgattctgaggaaggcctcgaagatgctgtggaaggtgctgatgaagccttacaaaaagcaataaagtcagactcctccagcccccaaagagtgcagagacctcactctagtcctcctcgctttgtgacagtagaagaacttctagagacagcgagaggtgtcaccaacatggctctagcccatgaaattgtagtaaatggagactttcagattaaaccagttgaattaccagaaaacagcttgaagaagagagtaaaggagattgtacataaagcgttttgggattgcttgagtgtgcagctaagtgaagatcccccagcatatgaccatgctatcaaacttgtaggagaaatcaaagagactctcttatctttcttgctgcctggtcatactagactgagaaaccagataacagaagtcttggatctggatctgataaagcaggaagcagagaatggggcgctagacatttccaagctggcagaattcattattggcatgatggggacactgtgtgcacctgctcgagatgaggaagttaagaaactaaaggacattaaggaaatagtgccccttttcagagaaattttttctgtgttggacctaatgaaagtggacatggccaactttgctatcagtagcatcaggcctcatctcatgcagcagtcagttgaatacgaaaggaagaagtttcaagagattttggagaggcaaccaaattccctggactttgtcacccagtggctggaagaagcctcagaggaccttatgactcagaagtataaacacgccctgccagtggggggaatggctgctggctctggggacatgcccaggctgagccctgttgctgtccagaattacgcttacctgaagcttctgaagtgggaccacctccagaggccgttccccgaaacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagtaagatcctcgtccgatcctaacgtgtatgcaccctacagcagcagtattactcactagccacagaatacctgttctgtactctaatgttgcattggaaaatggctatatagtacatgtctatttaacagcaccgattccaaagggaagaatattgtgtatcactgttgaaaagacttgttgagaaatccactgaattctattttgagagattgtatttatgagtgcaagtttacaaatcaaagaagcattttgttctcgagttttacaggtaacactcagctgttgtctccactcctcccccatcatgtccttccaaggaggctgggacctctctcttctgcaatctgggtagttctttcagatgcctcatgctgagctgacggccatccaagcgcaaaagagaccaagccatggcctcacctcctgccctccctcagacagccttgtccctcacccctcccttctggtatttttgttagaagggctatataacgtcttattgccattttctccccctatttattgcttcctccctgcctggcctagccagggctcccaagcccttttttctagaggagagttatttgtctctctctctttttttttttactttcttttttgtatttaaacattcttttaaccttcccccaaagatacagttattggactttaaaaagcttgttcttttatacaaaattactcctgcatctggttgagagcagttatgacttatgagatctagtgaaaggaaagtctttgactttcaagccttgaaagtcaaggaggaaatgtattgaaaaatagtttactgtaatgtgaacgaagagaaatgtctggaattcttactgaaaaattgaccctgagacaatacacagatgtgatgattgaattaaattctggaattaga

SEQ ID NO: 99 - DNA, 5046 bp, Homo sapiens
caaaccagcctcccagcggaagaccaagcttgctagcggtcaacgttgccggcagctctgcaagcgcttccagcgggcgtcgctctcctttcgggggtggtactttcattcggtcatcctgtgagtgttccacttcccgacggaggccgagcactcacaccgcggcggaggtacccgtcaccgcagaaccgggtggctggctctcctccagggagaaagcctgtcacttattcctcaacactgttgggaagttacctagaaaagtacagacagaagacctaggcttgcgttttagaatcgtggagtgttagcgctggccaaatcgttggacacaatgtaagcttgatcaggaaaatgagctccagggtctcacaggcggggcctggaatcttggcgcaatctgcgaccctcactgcctcctacagtcggggctgagcgttctttcaaacagccaaagtaatcacttaagtccagcaatgatctccttggagaaatcaaaagatcctccctaagagacggccttggagggcatcgcccctggggctgggcacagcacgtcttcccggccccggcgcgggaggagggtttggggacagcggccgcactccggacccttcttcagattgcacaggaggaggcggtagcggaacctttctcctccgcctggttctcgcttccacccgggcccagttggggacggacgcactagaggcgacctaaacatggagacagcgggcgctgcaactgggcagccggcctctgggctggaggctccggggtccacgaatgaccggcttttcctggttaaaggtggaattttccttggtaccgttgctgcagcgggaatgctagctggatttattacaacattatcattggctaaaaagaaaagccctgaatggttcaataagggaagtatggccacggctgcattaccggaaagcgggtcttcccttgccttgcgagctctgggctggggctccctgtatgcatggtgtggggttggtgtgattagcttcgcagtctggaaagctttaggagttcacagtatgaacgactttcgaagtaaaatgcaatcaatatttccaacaattcccaagaactccgaatcggctgttgagtgggaggaaacattgaaatccaaatgagatgagcatggatgaatttcaaaatgcttgttacagaaaggggtggctctggagacaccatgacagcaaaaggactgggactgatttctcccaggaacatgggcagattgctgactgaaccagtgcactggatagcattcagcctcatcacaggagagtatgtgtgtgcgtgctgggggagggtaaagttttcccacagttaagaagactatttaaaaatagtaattacaggaataacttccttatgtggaggggaccccataggaaatgattctgtttgtaacagttgaagcaaatttcatactaaaaaagtttataataaaagtatgataagaaaatatttataaaacagaccccctaatagcaatagtactgcaatgtgtctaattaaaggagtttcaagagcctttcttgtcaatatatgacagaacttggaagtcttattctgattagccagactacaaagtgacagtcacctggtaagtcctgtatggtaggaagtgggtgtggctctcgggtcctaaatgtggtctgtgctttacagccatcacacacatgctagttatttacctgatgcccttgcttgaaggccctataaattcttatacttaaaacaaaaagccagtaatgagttgtgatcaccccaaaaggcacagttgggctaaaataatgatgatatcaggggtaaacatatttttttgagaagttggtctggatctctgaacactgacaatttgtcattttgtctcagttgtcaaagtaaaaaaagcccagttgtcatccgtcttcaatatttttaaccagaaagtcacctgagtacggagtcccaatataaagtatttgggaccacctccctaacaaagctgttagggtaaattctgtgtgcacgcccaactccctcctgtcttccacagtctcctacaaaaaaaacagatggagaataatgtctacatgcaattgtttttactgcaattgtattttaaaatattttcaagaagagaaatactttaatatgtcaatatgtccagagaaaaaacctgtagttaaatatcagttgtgcaatttcttcctacttgcctaggctctaattagtcagcaatcaggtttaataaaggacatttgaaatttctgttatcatgaaaccttttattctaagggagatttttaaatgaaatgacaagaacttaatgtaatacttttctctagaccatgttaccctgttaaaattgctgtattgttaatgaaacaggtgtaatcagcatctggaattcatatgtaatctgttaaaaatccaagactgaaaggaaaggattgtgaaattggtcagtgaatgcgggtagcaaaaactcttcactgcctttcatttgtaactaaatctcctctgagaagagatctgtaggctttgaatgaaaggaaggaaaggcaggagccaaaggaacaggttttcgtccatacaattagtctgaatctaggttcctctgaatagaatgggcaccgcctgatccttttgtgcttcataaatgtgggtttccaacgtgcatgagatggccctcaaaccttgttacaacgatgcactttactcgtttgatgtggggggaaaaagaatgggcactacctaaaactgtttacagctagaatctgggttttatttttcatagatggagaatgcctagtggtttctaaaggcctccactgggtggagaaaggagacttgcccacctgtctggagtgttaaaaggagaaatcattgttaactgattctgttaatggattcctgccttgtaacctcccgaagggcagggacccctctcagggccttgtaaactggtgtcagcaccgctgcagaggctgctgcacatcaggctgatggcagctaggccctaggaaggagccaggggccatggtgggggctctgctttcccacagggctggcacagaggaggcctagacatatgttgctgaaagagtgtcctaatactagagtggcatgcctcgtgtctacaaaacccttatatgtcacctctgctgtccttgaccgatggcaggggaactcccattagaatgatgatgaatcccctgcagaggggaggctggcagggacaaattccctaaaagagggaccaagcgtcagctccaattgcatcttaaaagcaaaggtgaagtaatgcacagatggaaatttaaaaagaaaacaagcagtatgactcaagtggtgtttttcacagtcagaacttgaatatcagtagatttcgtcatttgtctattccttttgtaccagaggcatattgttaaattggttaatggaaaggaaaaatgttgaacagataatgttattctttatgagacgtaccatctgtgtattgagctctgaatgtccctggatatggaagagaggaaatgtgatggaatttcaagtttgccttctttgctgtctttatcttgggttgagtatgacaaacataatcacatttatctcctggagcataaagagttttaatcaccctattaaccaggatgacatttttcacagacttaaaaaggaatagaacagacattatctccctataagcaatccatttcatggaggctgagcactagaaatgctttaaaggatggataacgcaggccatttccatttcctgtctaagccaacattaaggaggctttcggtaaggctgttgcttccactgggtgagtgttaagctttacacttagagtctcagcgcccaaaagagctattagagaaagcacgggcagggaggagtggcttccgagaccccaggattcattcaagggaaaacatgtatcctggtaagttgctgctgccctgtgaaaaggagtccataggctgctgttatattcagagtcaagaaagtgtgggttcaggacaacctgagagtggaaagtgggggacgggagctgcctccgaagacgcccggcagcccatcaccaggaggaccatggcccaagggcatggaagcatgtggctgctgagagggtcgtgggccatctccaccaccaccctcgcgtcagggcatgggcccaggctggcgttaagggcactttgcctgcttagtcaaaaggtggcatcgaatcacctgggctgtcacatgttttgtttagtttcatggatagtatgggaccaaacttgcaaattaatcattgcaatctaaggggaaaatagaagaaattaaggtgggggtggggggacggggagcccatggggataaaagtaattaaaatccattgaatttagctatttcacttggggcaacatttaatctccaagattaaatcttggtttatggggaaggttatatattttcatctcatttttatgtatcatctttaagacaaattgttaagtacaaatgaaaatcaggtaacatacaaaggcatttcatcaaatagttaaatttcctatgaaagttagtaaaatacatatttttataataccatgttcaagtgaagtgtttttgctttctgccaagagtcattaaatgatatagcaagtatttgggtctctcttggtgttatcaggattaattgcccaaggctgcgattttgtgagcatagaagaggaaagcaagcatctctcacaagcagtgacatgaatctgtaataatgagtgaggctgttagcaaattttgtgtgatggcagataactcagttttggagaaaattagaatcacagctaccaagaagcacatatcgtttcaactttcccacccaagtattagtgaagtgatttaggaccttgatttatatttcttagagaagctggctcgaggcctttgtttcattactgtttgatgaggcatgatcccttactttaaaaaaaaaaaaaggtgaatgtattaaatgtacttaaagacataaaaaaaaaaaaaaaaaaaaa

SEQ ID NO: 100 - DNA, 2707 bp, Homo sapiens
gtatgctgctgctgccgggtgtccatggcccgcacccccaagctgccactgcagcagtcagagtggcagctgaaggctcggttcatgccgtgcccccgggcagttctggtgaggctaagcaagaggcctctgcatcttgacacctaggagagcagggacggagtctcccagggtggaggaccatgctgcgccgcaagccctccaatgccagtgagaaggagcccactcagaagaaaaagctctcccttcagcgctccagcagcttcaaggattttgccaaatccaaacccagctcccccgtggtgagcgagaaggagtttaatctggatgataacattccagaagatgactcaggtgtccccaccccagaagatgctgggaagagtggcaaaaagctggggaagaagtggagggcagtgatttcccgaaccatgaacaggaagatgggcaagatgatggtgaaggccctgtcagaagagatggcagacactctggaggagggctctgcctccccgacatctccagactacagcctggacagccctggccctgagaagatggcgctggccttttctgagcaagaggagcatgaacttccggtgctcagccgccaggcatcaacaggcagtgagctctgcagccccagcccaggttctggcagcttcggggaggaaccacctgccccccagtacacagggcctttctgtggccgggcacgagtccacaccgacttcactcccagcccctatgaccacgactcgctgaaactgcagaaaggagatgtgatccagatcattgaaaagccacctgtgggcacgtggctgggcctactcaatggcaaggtgggctctttcaaattcatctatgtggatgtgctgcccgaggaggccgtggggcatgcccgccccagccgccgacagagcaagggcaagaggcccaagcctaagaccctgcatgagctgctggagcgcatcggcctggaggagcacacatccaccctcctgctcaatggctaccagacactggaagacttcaaagagctgcgagaaacacacctcaatgagctgaacatcatggatccacagcaccgggccaagctgctcacggccgccgagctgctgctggactatgacactggcagtgaggaggctgaagagggcgccgagagcagccaggagccagtggcacacacagtgtcggaacccaaggtggacatcccgcgcgactcaggctgctttgagggctcggagagcgggcgcgatgacgcagagctggcaggcactgaggagcagctgcaaggcctctccctggccggggcaccttgaggtggcggtggcaataggccaaggctgggacccagctgcaaaggctgtaggagtgggcccagcctcccgtggtggcccaggtcctgaggactggcactgagcctggccctgcttccccagggacacttagggccacagaggccaggccagggccctacaggttccaggctcagctggagtggttggggagtcgcccaagggcacatcccacctgcctgagccccgccctccaccagcgactgacagcgcagcccctcctggcaccaactgctcccctgccatggccacggccacagcaagtggggcactgggaaaccctgcccatgtccctcaccaacaaggcctccaaatcctcctcacccccacaccacctacccctgtcgcactgctcctgaaaagggggccaagtcaatgtttcaggtcagtctaaaaaccctagggaagctggccatttaaaagaacccaaactgaccatgggtaaatccagttcccctaaataaggcctgaagaaatccacaggtaccattcccactttccttctccctagctttcttagaggtttggccactaaatcttatgagacttgaaccaagtggcttcctctttctaggcttaggacgggttggggttagaaagggtgatcactgaaggccttgcctgctctgacattctgtgacattaaatgtctattctcctgttacctgtggcctgggacaccagtggggtttatcgaggggaccagaggggcctcaggctttcagatgaaatggctcctcctactcacccactttattcctctccatgtaattcaggacaagctgcaacttcccccagcttaacacaatgcccatacctcatacgatatgcgccctcccgttccatccctggccccctcaaacgagacttctcacaaggctgattacagatggtcaaacctggcttccaaggacagaattgcctctcggaagccagctgtggatctgagtccagagttggccacttgtgtgggtcctcacaagcaaagagagcactaaacttgacattgggggtccaccactccaactttgctttctgaaggttttggtgtacattgagccccagaaggaaaggagagtatctgtgagtgggggcctcccttgaccccagtacgaagtctatgccctgaatccccagagtagcccttcctggtgcccaactggcctggggacaaacagcgtccactacatctaggactgccggctaagtggacacacttcttgacctcctaccaggaactttggtaaaagctagctttggggaaggggttgggtgtaaatatgagagggtggagggagaccagctggtagcaataaacatgggtagaactaaaaaaaaaaaaaaaa

SEQ ID NO: 101 - DNA, 3184 bp, Homo sapiens
atccaatgaaggttactggctgagcggggacaccttctcacaggactggagagagaatgcggggcagctgggcagggctcacttccagccgcctgtcacagtactgggagtaagaggtgacctatttatttttagaagggggcagtgataataacccagctcctagcttcattcaagggaggcaggcgctttggaagtttgtaaacaccaactttctgagtaagggaggagcactttttttccaaaaaggaaagaacgtctctactgggtttttttcctcctgatattcagcattagagtagaaaagaaactattgtttggccacattagccgtggttagcaggtgctgcagcctttgccactgttattatttttaaagggcagaaatgcctgaaggtgaagactttggaccaggcaaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagacaaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatggaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaatagtcgttatcagtaaaaaaaaaaaaaaaaaaaaaaaaa

SEQ ID NO: 102 - DNA, 3340 bp, Homo sapiens
gccatcttgcccgcgtccgggctcctgcggcgggcggggcggtgtcccggccggaagcggctgtgcggcggccgcgctgccacctcagggaaatttggatatgtgcagtgcatctcctcgaagatgctgatggtggaaatttcttgaaaccgctctcgtaatttgccacgtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacctagctatatttgatcttcggaatacaagccaaaagatgttcgtaaatacaaaagctgttcagggtgtgacggtagacccatatttccacgatcgtgttgcttccttctatgaaggtcaggttgcaatatgggatcttagaaaatttgagaagccagttttgacattgactgagcaaccaaaacccttaacaaaagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaaatgaagatccacagctcaagtcactctggtatactctgcactttatgaagcaatacacagaagatatggatcagaaatctccaggcaacaaaggatcattggtttatgcaggaattaaatcaattgtaaagtcatcgttgggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtcggcatgcacgtgtaaatgtatgcagttggatacaacagggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatcagcagttttgatgtttgagtgattttgatatgcttcacagagacaaatgctgccaaaataaacatcgaagtatagacatgagttctgttcagcaggttgaaaagtctgatttagaaaaactttctaagttttggttgaaattatgaacactctagaagcagaatttctggaagagccaagaacagactttgagcctatatcttcaaagctgaaactggatatctttcaataaaatatgtgcacttttaaaataaaaaaaaaaaaaaaaaaa

SEQ ID NO: 103 - DNA, 2244 bp, Homo sapiens
tatcgccgcctcagacagctttcagtctgtccctcctacaactcccacaaggcccctcggccccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagactcaattgtaaaaaaaaaa

SEQ ID NO: 104 - DNA, 3018 bp, Homo sapiens
ggggaggggtgtgacgtacatccggcgagtagctggcggtcccgggtgctgctggttagtgtgctctgagggagggtccgagccagccgctgttttgccggaggagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttttttttggtatgaaattgtctttctccattgcagaaataagctagggaaacactaacccaaaaactttctgtagagctgttcctttggaggcagcatcacttattggcagtaaagactcagtataaaagcaccggcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgagggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaagttaaaacaaaaaaaaaaaaaaaaaaa

SEQ ID NO: 105 - DNA, 1511 bp, Homo sapiens
ccgagcctagtgcctcccacgcccggcggccgcgagccggggtccgcgagggcggagtggggcgcggcagccaggaacccgactacgaatcccagggtgcgggcgggcggagcgaggagggacgctgggcctgcccggtgcgcacgggggcggggaccggcaaggcgggaccatttcccggcataggctccggtgcccctgcccggctcccgccgggaagttctaggccgccgcacagaaagccctgccctccacgccgggtctctggagcgccctgggttgcccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccaccatggggaatgggatgaacaagatcctgcccggcctgtacatcggcaacttcaaagatgccagagacgcggaacaattgagcaagaacaaggtgacacatattctgtctgtccatgatagtgccaggcctatgttggagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctggccgctccaggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagtttaaaaaaaaaaaaaaaaaaaaaaaaaaaaaaaa

SEQ ID NO: 106 - DNA, 3568 bp, Homo sapiens
ggccgcattccatgcctccaatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccagggggcttgtacatgacagctggaatagcctccagttgaggggcttggtggtgctccttatctctaaagcagctgggcccagcagcgtgaacacttcatgtcagaactatgacatggtcagtgggatctactcatgtcaaagaagtttggcagagatcacggagctaattcatattgctctccttgtacatcgtgggatagtaaatttaaatgagttgcaatcatctgatggtccactgaaagacatgcaatttggaaataaaattgctatcctgagtggagactttcttctagcaaatgcctgcaatggactagctctgctacagaacaccaaggttgtggaacttttagcaagtgctcttatggacttggtacaaggagtatatcatgaaaattctacttcaaaggaaagttatatcacagatgatattggaatatcgacttggaaggagcagacttttctctcccatggtgccttactagcaaagagctgccaagctgcaatggaattagcaaagcatgatgctgaggttcagaatatggcatttcagtatgggaagcacatggccatgagtcataagataaattctgatgtccagccttttattaaagaaaagaccagtgactccatgacttttaatctaaactcagctcctgtagtcttacatcaggaatttcttggaagagatttgtggattaaacagatcggagaggctcaagaaaaaggaagattggactatgctaagttgcgagaaagaatcaaagctggcaaaggtgtgacttcagctattgacctgtgtcgttaccatggaaacaaggcactggaggccctggagagctttcctccctcggaggccagatctgctttagaaaacattgtgtttgctgtgaccagattttcatgacatcaaattaaaaagacactattgttagttagctgaaaatcctagggaatgaggttgattgggagcgctttcacgatgcgttaatgacttttaaaacatatgcatttttccttccttttatcacattgctaaatgagttctgctttctttttggaactgctacaaacaaaattagaagaaaaaaaggtcaagcagttttcacttgtcacgccagaagcacacttgaggctgcagtcgcagaaataattaatgagattcgctcctgtgacctcagcaaatggacaggaaataagtccttattgattggaccgagccagggatggcgccagggcggtggcctgtggtttttcctgctagagaggacaaagcaagttggaagctgcaggtgtcaagagaaatgctctcaataccaaccagggaggattgtctaatcaaaaactagtgaccaatttgtcataatggagagtagttcaatggattgagaaaaatatgttttatttgttggcttgtaattatgtctctggattattattattttttttttagatgtagttttgctcttgttgcccaggctggagtgcaatggtgcagttttgactcactgcaacctccgcctcctgggttcaagtgattctcctgcctcagcctcccgagtagctggaattacaggcacctgccaccacgcctggctaattttgtatttttagtagagatggggtttcactatgttggtcaggctagtctcgaactcctgacctcaggtgatccgcctgcctcggcctcccaaagtgctgggattagaggcttgagccactgcacctggcctcatgtctctggatttataatgcagtatgaatatactttgtgctttatggtttttataatgtctttttggagaaattgccgaaaagttgccaaatacttgaagtaggagattaaaatgttatcaaatgttaaattggttatattaggaatagtctgtttttctttcctgaagatcagtttttttattcaaacacatttcaaagaaccaaattttttttttctttaaggaaaaaggagctttttttcaagtgaaatgtattcatttgtaatactttggtttaaggcatactttaatttttacgagtttcagaaacagaatttttgtactagggaattcattggtgagagtgttcttttaacctcagaatgtcaaattttggtcttgaaccacagacatccaattacagaaagaatataagcaatctcacaggcctgcaatcggacactgtctctgtgtggttcataggagatgatttttgaggtttgcactcatgcaatttgagaacaccgttgacaagaaggctgagtttacataaatgatctagattgaaactcagctacctttcttcctcatgtggtgtaattacagccctatctggagacagcgaatacagcaaacagattttattacctagttcgctcaaacactacatgaagttattttagttaaagccctcccccaaaagttataaaaccattttatcagggcccaacatgtggcatgcaatgaagagaaaatgtaaagctacagaggttaatgtattgtattataaaatattttaagtgtactcaaaatatcataattgtacagtttatgccaccataatttgaggcctatagatttagcttaagagaacactgttctgtttgaaatgctttctgtcactgaaattggcttaattagtaaccatggataagatgctttagatcagactaggttttaatcattaacttccacaaagaagtcatactttgcgttaggtgtgctggttggatgtgcaggaacttcagcaagcagtaggttttactaagcagatggtcgggcactgcagggcaccaggcaggatcctagggcgcctcttattctgcgttagcatctggtttgctgtatgaccttgcacaagtcacttccttctgagcctcaattttctcatctgtacaatgagattcaaaagttgacctgaaagtcaagtgtgaaaaaaaaaaagagattaaacaagataattatgaaattcttaaaaaaaaaaaaaaaa

SEQ ID NO: 107 - DNA, 1727 bp, Homo sapiens
agccggcgcgcggcggcggcaggaagtctgtgcccgagaacagcagaaataagagccagggagggaccgcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaagatcttcgagttcaaagagaccctcggaaccggggccttttccgaagtggttttagctgaagagaaggcaactggcaagctctttgctgtgaagtgtatccctaagaaggcgctgaagggcaaggaaagcagcatagagaatgagatagccgtcctgagaaagattaagcatgaaaatattgttgccctggaagacatttatgaaagcccaaatcacctgtacttggtcatgcagctggtgtccggtggagagctgtttgaccggatagtggagaaggggttttatacagagaaggatgccagcactctgatccgccaagtcttggacgccgtgtactatctccacagaatgggcatcgtccacagagacctcaagcccgaaaatctcttgtactacagtcaagatgaggagtccaaaataatgatcagtgactttggattgtcaaaaatggagggcaaaggagatgtgatgtccactgcctgtggaactccaggctatgtcgctcctgaagtcctcgcccagaaaccttacagcaaagccgttgactgctggtccatcggagtgattgcctacatcttgctctgcggctaccctcctttttatgatgaaaatgactccaagctctttgagcagatcctcaaggcggaatatgagtttgactctccctactgggatgacatctccgactctgcaaaagacttcattcggaacctgatggagaaggacccgaataaaagatacacgtgtgagcaggcagctcggcacccatggatcgctggtgacacagccctcaacaaaaacatccacgagtccgtcagcgcccagatccggaaaaactttgccaagagcaaatggagacaagcatttaatgccacggccgtcgtcagacatatgagaaaactacacctcggcagcagcctggacagttcaaatgcaagtgtttcgagcagcctcagtttggccagccaaaaagactgtgcgtatgtagcaaaaccagaatccctcagctgacactgaagacgagcctggggtggagaggagggagccggcatctgccgagcacctcctgtttgccaggcgctttctatacttaatcccatgtcatgcgaccctaggactttttttaacatgtaatcactgggctgggtgcagtggctcacgcctgtaatcccaacactttgggaggctgaggcaggaggactgtttgagttcaggagttttaagaccagcctgaccaacatggtgaaaccccatctctactaaaatataaaaattagccgggtgtggtggcgagcacctgtaatgtcagctacttgggaggctgaggcaggagaatcacttgaacccaggaagcggaggttgcaatgagctgagatcacaccactgcactccagcctgggtgacagattgagactccctctcaaaaaaa

SEQ ID NO: 108 - DNA, 2867 bp, Homo sapiens
gactccggctgcagccgcgggaggtccggacactggcggccatggaactcaccgggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttcttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataattttcaaaaaaaaaaaaaaaaaa

SEQ ID NO: 109 - DNA, 2413 bp, Homo sapiens
acctctgtaggcgatcctgctctcgccgtggctttcgggtgctaggagacagttgccggcgttgggttgtgcgagacgctaactgtaccctccgggtttaacgctgtgaggcagcgcgcggaggaactggggataagcgccccggagcccccaaacagagcgcggccgctgggggacagcgcgcggcgccgggtcggggcggggcggcttttctgtcggaggacgcgaaccggcacgctgcgcctttaaggagtccagctgggctgggcgccggagctgggagcggcgcgggtaggagcccggcggcaggtcccagcccggggctagagaccgagggccggggtccgggcccggcggcgggacccaggcggttgaggctggtcaggagtcagccagcctgaaagagcaggatggatcttgatgtggttaacatgtttgtgattgcgggcggcacgctggccatcccaatcctggcatttgtggcttcatttcttctgtggccttcagcactgataagaatctattattggtactggcggaggacattgggcatgcaagtccgctatgttcaccatgaagactatcagttctgttattccttccggggcaggcctgggcacaaaccctccatcctcatgctccacggattctctgcccacaaggatatgtggctcagtgtggtcaagttccttccaaagaacctgcacttggtctgcgtggacatgccaggacatgagggcaccacccgctcctccctggatgacctgtccatagatgggcaagttaagaggatacaccagtttgtagaatgcctgaagctgaacaaaaaacctttccacctggtaggcacctccatgggtggccaggtggctggggtgtatgctgcttactacccatcggatgtctccagcctgtgtctcgtgtgtcctgctggcctgcagtactcaactgacaatcaatttgtacaacggctcaaagaactgcagggctctgccgccgtggagaagattcccttgatcccgtctaccccagaagagatgagtgaaatgcttcagctctgctcctatgtccgcttcaaggtgccccagcagatcctgcaaggccttgtcgatgtccgcatccctcataacaacttctaccgaaagttgtttttggaaatcgtcagtgagaagtccagatactctctccatcagaacatggacaagatcaaggttccgacgcagatcatctgggggaaacaagaccaggtgctggatgtgtctggggcagacatgttggccaagtcaattgccaactgccaggtggagcttctggaaaactgtgggcactcagtagtgatggaaagacccaggaagacagccaagctcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgagaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctctagccctcagagcgtccggagcagcagggtacatgggtgggaggttcattcagcacccaccagtcaggtatgttctgagtgaacccacagcagtcgcagaatgagcacctggcagggtgggtttcctaggaataatttattatttttaaaaataggcctaataaagcaataatgttctagacatctgtctaagtaatcagactcaggttccacacacaagcaacaactcgtgggcctcttttctatttcaatgtgctactaagaacccttggatgtaacatactagttagttaatgaattctgtgaattctgtgaagagtaatgtgattgaaaataagtctaaacagctgtaaaagtgaccacaatgacatgaaataaatttaataagtctagatcagcaaaaaaaaaaaaaaaaaaaaaa

SEQ ID NO: 110 - DNA, 755 bp, Homo sapiens
gccggcgccagggcaggcgggcggctggcagctgtggcgccgacatggctgcgctggtggagccgctggggctggagcgggacgtgtcccgggcggttgagctcctcgagcggctccagcgcagcggggagctgccgccgcagaagctgcaggccctccagcgagttctgcagagccgcttctgctccgctatccgagaggtgtatgagcagctttatgacacgctggacatcaccggcagcgccgagatccgagcccatgccacagccaaggccacagtggctgccttcacagccagcgagggccacgcacatcccagggtagtggagctacccaagacggatgagggcctaggcttcaacatcatgggtggcaaagagcaaaactcgcccatctacatctcccgggtcatcccagggggtgtggctgaccgccatggaggcctcaagcgtggggatcaactgttgtcggtgaacggtgtgagcgttgagggtgagcagcatgagaaggcggtggagctgctgaaggcggcccagggctcggtgaagctggttgtccgttacacaccgcgagtgctggaggagatggaggcccggttcgagaagatgcgctctgcccgccggcgccaacagcatcagagctactcgtccttggagtctcgaggttgaaaccacagatctggacgttcacgtgcactctcttcctgtacagtatttattgttcctggcactttatttaaagatatttgaccctca

SEQ ID NO: 111 - DNA, 1479 bp, Homo sapiens
ttgcgctccccaagtctctctcgtgcgcagagcccaggctgcgcttccctggtcaggcacggcacgtctggccggccgccaggatgcaggccccgcacaaggagcacctgtacaagttgctggtgattggcgacctgggcgtggggaagaccagtatcatcaagcgctacgtgcaccagaacttctcttcgcactaccgggccacaatcggcgtggacttcgcgctcaaggtgctccactgggacccggagactgtggtgcgcctgcagctctgggatatcgcaggtcaagaaagatttggaaacatgacgagggtctattaccgagaagctatgggtgcatttattgtcttcgatgtcaccaggccagccacatttgaagcagtggcaaagtggaaaaatgatttggactccaagttaagtctccctaatggcaaaccggtttcagtggttttgttggccaacaaatgtgaccaggggaaggatgtgctcatgaacaatggcctcaagatggaccagttctgcaaggagcacggtttcgtaggatggtttgaaacatcagcaaaggaaaatataaacattgatgaagcctccagatgcctggtgaaacacatacttgcaaatgagtgtgacctaatggagtctattgagccggacgtcgtgaagccccatctcacatcaaccaaggttgccagctgctctggctgtgccaaatcctagtaggcacctttgctggtgtctggtaggaatgacctcattgttccacaaattgtgcctctatttttaccattttgggtaaacgtcaggatagagataccacatgtggcaagccaaagatctatgcctctgttttttcagtgagagagaaatagcaaatgttctttctatgctttcctcaccatcatcacagtgtttacaaacttttgaaaatatttagtctgttacaaacttctgtcatgtagctgaccaaaatcctgcagggccacagtcggcactgttatttgcttcttttaatcagcaaaggcctcaagtcttaaaataaaaggggagaagaacaaactagctgtcaagtcaaggactggctttcaccttgccctggtgtctttttccagatttcagtatattctctgatggcctgacaggcctattaagtagatgtgatattttctcccaagatgacctccattctcggcagacctaagagttgcctctgagttagctctttggaatcgtgaacacaggtgtgctatattgtccttgtcctaactgtcacttgccatggcctgaatgttggcttaactgaatattgtatgaaaagacatgcctccatatgtgcctttctgttagctttctctgactcaagctgtggggctcctctatacatgctatacatgtaatatatattatatatatttttgcaagtgaacaataaaacattaaaagatgctgtttccctatttaaaaaaaaaaaaaaaaaaaa

SEQ ID NO: 112 - DNA, 1160 bp, Homo sapiens
ggctcttcgcgcgcagtcccttagggggcgcctggaagcccggcgcatgcgccctgagggctcgctgacctaccgggtgccagagaggctgcggcagggttcctgtggcgtgggtcgggcagcacaggccttggtgtgtgcgagtgccaaggagggcaccgccttcaggatggaggctgtgcaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcgtgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacagcagtactcagcatggtcttatgcacaggaactaaaggaaaaagagatcgagtcacaaaaattcaggaagagggggtaaatgtggattgtatggaatgaaaaataaacattctcaagg

SEQ ID NO: 113 - DNA, 4651 bp, Homo sapiens
gctgtggggctgtgggtggggcggcggccgcggccctggcattcgcgcttgggtctggagatagcgcgagagactcaccggctcctgggaacccagtcgagggcccgggccaggggcataagaggaagttgtcccgagtggctcgcctctggccctgggagaggcggccccgggagccggcgtcccgcccccggcggcctcattccccgaccctcctccccggctgcgcgcgccggccctggctgtatctcgggggctgcggcgggaactgccgagcgggcttgactggacgcactgcctgaggacctgcggaggagacgagggagcgcggcgggtcagccccgaggttaggccgcgggtcccctgtccgtggcgctccgtccttttcccagccgtcttggctacagaatctgcgacctccccacactccttctcttttgagtatgtcacttaagtcttctcgccggatgctttttcctccttgcttttgccggaaaggagagagatacatgtgaaggatatctgtcctcgttgcttcccctgccctctcaaaagtttaacttctgtgggaatgtgtatcttccttttctggaccatttgacagtcccgccccagccgccgtgtgatttagcaaccggtatcatattcagatcaaatcttaaaaaaaaaaagtcacctacagaactacagaattgttctctcccgctcaagaagggcaagtggactttggcgttaagatgcaggggggtgaaccagtgtccacaatgaaagtctcggagagcgaaggaaagctggagggccaggccacagcggtgaccccgaacaagaacagcagctgtggaggtggaatcagtagcagcagcagcagccgcggtggcagtgcaaaaggctggcagtacagtgatcacatggaaaatgtgtatggctatttaatgaagtataccaaccttgtcactgggtggcagtacaggttttttgttttaaacaatgaagctgggctgttggagtactttgtgaatgaacagtctagaaatcagaaacctagaggaactttgcagcttgcaggagctgtaatatcacccagtgatgaggattctcacaccttcactgtaaacgctgccagtggggaacaatataaactcagagctacagatgcaaaagagcgacagcactgggttagcagacttcagatatgtacacagcatcatactgaagctattggaaagaataatcctcctctgaagtcacggagcttctcacttgcatctagtagtaattctcctatatcgcagaggagaccaagtcaaaatgccatttctttttttaatgttggacattccaaactgcaatcactgagcaaaagaactaatttacctccagaccatcttgtggaagtcagagaaatgatgtctcatgctgaaggacaacaaagagacttaattagacgaattgaatgccttcctacttctggccatcttagttccttggaccaggatctcttaatgctcaaagctacttccatggcaactatgaactgcttaaatgactgctttcatattctccagttacagcatgcatcacatcagaagggctcattgccttcaggaacgacaatcgagtggttagaaccaaagatatctttatcaaaccactataaaaatggagctgaccagccctttgcaactgatcagagtaagccggtggcagtcccagaagagcagcctgttgcagaatctggactattagcgagggagcctgaagaaataaatgcagatgatgagatagaggatacatgtgaccacaaagaggatgacctgggagctgtagaagaacaacgtagtgtcatcctacatctcttgtcacagcttaagctgggcatggatttaacaagagtggtgcttcctacatttatcctagagaagcgttccttgctggaaatgtatgcagactttatgtctcatccagacctatttatagccatcactaatggagccacagctgaggacagaatgattcgctttgttgagtactaccttacctcatttcatgaaggccgtaagggagccattgctaaaaaaccatacaatcctatcattggagaaacatttcactgttcctggaagatgccaaaaagcgaggtagcatccagtgtttttagcagttcttccacccagggagtcacaaatcatgctcctttatcgggggagtctttgacccaggtgggatcagactgttacacagtcagatttgttgctgagcaggtttctcatcatcctccagtctcaggattttatgcagaatgtacagagaggaagatgtgtgtaaatgcgcatgtctggactaagagcaagttcttaggcatgtcaataggcgtgacaatggttggagaaggtatccttagtctgttggagcatggagaagagtacacattttctctaccctgtgcatatgctcggtcaattttgactgttccttgggtagaactgggtggcaaagtcagtgtcaactgtgcaaaaactggatattcagccagcatcacttttcataccaagccattttatggtggcaaactgcatcgggttacagctgaagtaaagcacaacatcaccaacactgtggtatgcagagtgcaaggggaatggaatagtgttcttgagttcacatatagcaatggagagacaaagtatgtggacttgactaaattggcagtgacgaagaaaagagtgagacctctggagaagcaggatccatttgaatccaggcgattgtggaaaaatgtgacagactcgctgagagaatctgaaattgataaggccacagagcataagcataccctggaagaacgtcagaggactgaagaaaggcatcgtactgaaacaggcacaccttggaaaaccaaatattttattaaagagggagatggctgggtttatcataaaccactttggaaaataattccaacaacacaaccagcagagtgacacatactatctaaaactcgaccaaatgaggttcttctctgtttaccctaaatcctcccagaatggagtcattgcactgagtgacctgcttcctgattgcgcagactgaaactagctaaacctgaatgtacctactagggcaccataatactgcagcaagaccaaagtggtaaagaaacacagtggaccttttaccaacctgttcatgtgatgtgagcaataccatcttaaaacttgttacctgaatcagtagatgaatcttttatccagttcttgctcctaaagttaagtttgaatcccctatttttgcacaggggcagcagatacacacaacaatgagaactcagtgactttgatttctttgtagtgaaaagtgaagtctccgtttcagagtttgtgtctttctttctgtccataactgaagtattcactactcttgtaaaccaaccaagaggaggagaaagatgacccagaagtggattcagccattgtgcctgaaatcagtgtttaaaaaaaaaaatcaaccaggttgtggtaacaaggcattctatttcttcaaaaagactgtatgcctgtgtctgaggaacttacctattatccacctctgttggaactctcttttaaaaagtacatttatagattgatcagaattataaccatggagaattttttcttctgagcattttaatatacttgaaaacaacattgacttgaaaaatttcagaacatttttcagtacctagttttattaaatattacacttgagagacactttttaaaaatgtgttaatgtcaatatgatgagattttagcctttctccagaactaaggcattaaagaaaatagcaaatattaaaaaataaaactgttacttttttccttctttcttttcacctttaggttaatatccagtattatgtgttatccctttggataagtatgctttattttacctctgttaaaaattaaaataaatgattctattcatatttgtcagtaattcaaaacttatatgtgtaactgaacgcgcatgtaaggtatggttttatttattttttttttttttgaggaaatttaaatgctaaagaaacaacgaaatgaaaaggtatcaggaaaaaaagatcaggaagttgtattcaggtacaaatctttttttaaataagtattttgttgaggttgaagaattgctggcaattaaaagaatagagctaattatggctttcatcattcattcatgtatttattgagcacctacttattatggtgctcaacacttgttactgcaagctaccttaatttcccaagagtggtgccttactctgttttttctgatatggtcttccaatcagtgtgtgtaacatacctgttgtttatcagccattgtaggtggctgtgtctgttgcatcatcataagaagtttaagctttgtgctctgataaattgtgttctgttaaagaggttagtaggatgaaaacagcaaaacaataattttttcaacaaattgtaaattataagaaaaagagttggtttgtgtacaacaattttaatgattcccttgttcatttttgctgtgaaatgcactgaaaaaaatcctcaaaatgagttatagttcctgtgttgggaaaattgacaaataataaaactagagaacaaacaaaaaaaaaaaaaaa

SEQ ID NO: 114 - DNA, 3137 bp, Homo sapiens
agcaccgtctgggctgtggaagcggagggggtggggacactctggcccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaggagaaaaaaaaaaa

SEQ ID NO: 115 - DNA, 5644 bp, Homo sapiens
gctcccggaagcggcggccgcggcgcggagccgagcgggcgtccgtcgccggagctgcaatgagcggcgcccggaggctgtgacctgcgcgcggcggcccgaccggggcccctgaatggcggctcgctgaggcggcggcggcggcggcggcggctcaggctcctcggggcgtggcgtggcggtgaaggggtgatgctgttcaagctcctgcagagacagacctatacctgcctgtcccacaggtatgggctctacgtgtgcttcttgggcgtcgttgtcaccatcgtctccgccttccagttcggagaggtggttctggaatggagccgagatcaataccatgttttgtttgattcctatagagacaatattgctggaaagtcctttcagaatcggctttgtctgcccatgccgattgacgttgtttacacctgggtgaatggcacagatcttgaactactgaaggaactacagcaggtcagagaacagatggaggaggagcagaaagcaatgagagaaatccttgggaaaaacacaacggaacctactaagaagagtgagaagcagttagagtgtttgctaacacactgcattaaggtgccaatgcttgtcctggacccagccctgccagccaacatcaccctgaaggacctgccatctctttatccttcttttcattctgccagtgacattttcaatgttgcaaaaccaaaaaacccttctaccaatgtctcagttgttgtttttgacagtactaaggatgttgaagatgcccactctggactgcttaaaggaaatagcagacagacagtatggaggggctacttgacaacagataaagaagtccctggattagtgctaatgcaagatttggctttcctgagtggatttccaccaacattcaaggaaacaaatcaactaaaaacaaaattgccagaaaatctttcctctaaagtcaaactgttgcagttgtattcagaggccagtgtagcgcttctaaaactgaataaccccaaggattttcaagaattgaataagcaaactaagaagaacatgaccattgatggaaaagaactgaccataagtcctgcatatttattatgggatctgagcgccatcagccagtctaagcaggatgaagacatctctgccagtcgttttgaagataacgaagaactgaggtactcattgcgatctatcgagaggcatgcaccatgggttcggaatattttcattgtcaccaacgggcagattccatcctggctgaaccttgacaatcctcgagtgacaatagtaacacaccaggatgtttttcgaaatttgagccacttgcctacctttagttcacctgctattgaaagtcacattcatcgcatcgaagggctgtcccagaagtttatttacctaaatgatgatgtcatgtttgggaaggatgtctggccagatgatttttacagtcactccaaaggccagaaggtttatttgacatggcctgtgccaaactgtgccgagggctgcccaggttcctggattaaggatggctattgtgacaaggcttgtaataattcagcctgcgattgggatggtggggattgctctggaaacagtggagggagtcgctatattgcaggaggtggaggtactgggagtattggagttggacagccctggcagtttggtggaggaataaacagtgtctcttactgtaatcagggatgtgcgaattcctggctcgctgataagttctgtgaccaagcatgcaatgtcttgtcctgtgggtttgatgctggcgactgtgggcaagatcattttcatgaattgtataaagtgatccttctcccaaaccagactcactatattattccaaaaggtgaatgcctgccttatttcagctttgcagaagtagccaaaagaggagttgaaggtgcctatagtgacaatccaataattcgacatgcttctattgccaacaagtggaaaaccatccacctcataatgcacagtggaatgaatgccaccacaatacattttaatctcacgtttcaaaatacaaacgatgaagagttcaaaatgcagataacagtggaggtggacacaagggagggaccaaaactgaattctacagcccagaagggttacgaaaatttagttagtcccataacacttcttccagaggcggaaatcctttttgaggatattcccaaagaaaaacgcttcccgaagtttaagagacatgatgttaactcaacaaggagagcccaggaagaggtgaaaattcccctggtaaatatttcactccttccaaaagacgcccagttgagtctcaataccttggatttgcaactggaacatggagacatcactttgaaaggatacaatttgtccaagtcagccttgctgagatcatttctgatgaactcacagcatgctaaaataaaaaatcaagctataataacagatgaaacaaatgacagtttggtggctccacaggaaaaacaggttcataaaagcatcttgccaaacagcttaggagtgtctgaaagattgcagaggttgacttttcctgcagtgagtgtaaaagtgaatggtcatgaccagggtcagaatccacccctggacttggagaccacagcaagatttagagtggaaactcacacccaaaaaaccataggcggaaatgtgacaaaagaaaagcccccatctctgattgttccactggaaagccagatgacaaaagaaaagaaaatcacagggaaagaaaaagagaacagtagaatggaggaaaatgctgaaaatcacataggcgttactgaagtgttacttggaagaaagctgcagcattacacagatagttacttgggctttttgccatgggagaaaaaaaagtatttccaagatcttctcgacgaagaagagtcattgaagacacaattggcatacttcactgatagcaaaaatactgggaggcaactaaaagatacatttgcagattccctcagatatgtaaataaaattctaaatagcaagtttggattcacatcgcggaaagtccctgctcacatgcctcacatgattgaccggattgttatgcaagaactgcaagatatgttccctgaagaatttgacaagacgtcatttcacaaagtgcgccattctgaggatatgcagtttgccttctcttatttttattatctcatgagtgcagtgcagccactgaatatatctcaagtctttgatgaagttgatacagatcaatctggtgtcttgtctgacagagaaatccgaacactggctaccagaattcacgaactgccgttaagtttgcaggatttgacaggtctggaacacatgctaataaattgctcaaaaatgcttcctgctgatatcacgcagctaaataatattccaccaactcaggaatcctactatgatcccaacctgccaccggtcactaaaagtctagtaacaaactgtaaaccagtaactgacaaaatccacaaagcatataaggacaaaaacaaatataggtttgaaatcatgggagaagaagaaatcgcttttaaaatgattcgtaccaacgtttctcatgtggttggccagttggatgacataagaaaaaaccctaggaagtttgtttgcctgaatgacaacattgaccacaatcataaagatgctcagacagtgaaggctgttctcagggacttctatgaatccatgttccccataccttcccaatttgaactgccaagagagtatcgaaaccgtttccttcatatgcatgagctgcaggaatggagggcttatcgagacaaattgaagttttggacccattgtgtactagcaacattgattatgtttactatattctcattttttgctgagcagttaattgcacttaagcggaagatatttcccagaaggaggatacacaaagaagctagtcccaatcgaatcagagtatagaagatcttcatttgaaaaccatctacctcagcatttactgagcattttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaatttttgtatttttagtagagacgggggttccaccatattggtcaggcttatcttgaactcctgacctcaggtgatccacctgcctctgcctcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttttgtctgacaaaaaaaaaaaaaaa

SEQ ID NO: 116 - DNA, 3148 bp, Homo sapiens
cctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcagagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctgaaaaaaaaaaaaaaaaaa

SEQ ID NO: 117 - DNA, 2963 bp, Homo sapiens
agtatgccccgcgccgtctccctggccacggttccaaacagccgtggcccgcggtgtctggcgctcggtgggtgtggttgcccctagtttgaggcctgcccgattacccgcaagacttgggcagccccgggcgccgctccgaccacgacagggaaaggaaccttaatctcatctttaaaataaggagaattactgagtgacctgaaggacccttttcagctggaaagtctgaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgaagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagacacaaagaccatcaccaccatggctgaagacatgtccccaggaccaccaattttcaacagtgtgatggccaggaccaagatgaaacgcatgagggaatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctaggcaactatcaaaaagaagcagaagttcaagtggacaaatttatgtgaaaattcatttaacatataagctgaactctattatggggaatggatacaaaagcagagctcccatcttgactttcaattcctcatcagaagtactggcttctttagagagtagtaagcatggctgcctatgcttggagtcataagtgttatttggactataccctgagataagcttatagatcaagtttggctcccttgaaaagcatttctctcatgtgcgccctcagggcttccagcaggattgagtcaccctgacgatgaccggggagaagccgtgtgctcttcattattttcagctggaggacagagctcagtgcctgactgcctagggtctcatggactgtaggcagcctgccagtgaaggtcactggactctagcctacaacatgctgagctacagcccagaagccagacatgcctgtcttagctgacctgtttttggtccacttttgcccttccatgactaataaggaagatatgtgtgtatttcatacacacacaaggacctggattaaaaatccaaaaagtgattctcttctatgatttatttcaaactcatccatagataattcaagatttgtattcaaaataaacatagttttcacagttacaaaataaatcacctattttatcttttccttaaaaaaaaaaa

SEQ ID NO: 118 - DNA, 2290 bp, Homo sapiens
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtaggtatatgttacgagaacgcccttcagcactgctcaaaaattttcggcatgtatttcatctagtcatgtccttttggtcctctaaattagcagtggtttggcataatagtgttttgtgttttttttctcattgaaataaatcttgggtttgtttttttcccgagcctgctagggcgaggggggtgaatggttgatgagtttaaaaataatgcagcccttgtttttcacctgtagaatatgagaacattttaacagcacctctcttatcttgcagatatattccaagatgctacatgcagcagacagctgtgagcttgcatacacacacacacaaatatacatgcacatacatacacagaatgcagtactagttaagtatttccttcctatctttaataagtaagagaatatttagaccatt

SEQ ID NO: 119 - DNA, 3775 bp, Homo sapiens
caagagcgcctggatccatccgacagccgcgggtgcgtggtcgtgcggcaagtgagcgatttggtgaacagacactcccttctgtagccatggattgttacagaacttcactaagcagttcctggatttaccccactgtgatcctctgcttatttggttttttctccatgatgagaccctcagaaccattccttatcccatatttatctggaccagataaaaacctgaccagtgcagagataacaaatgagatcttccccgtttggacatactcctacctggtgctgctgctgcctgtgtttgtcctcaccgattatgtccgctacaagccagtcatcatcttgcaaggtatcagtttcatcattacctggctgctgctgttgtttggccaaggagtgaagaccatgcaggttgtagagttcttctatgggatggtcaccgccgccgaggtggcctactacgcctacatatacagcgtggtcagccccgagcactaccagagagtgagcggctactgcaggagcgtcacgctggccgcctacacagcagggtcggtgctggctcaactcttggtatccctggcgaacatgtcgtacttttacctcaacgtcatatccttggcctctgtctccgtggctttccttttctcacttttcctaccaatgcccaagaaaagcatgttttttcatgcaaaacccagcagagaaataaagaagtcatcaagcgtgaatccagtattagaggaaactcacgaaggtgaagcaccaggctgtgaagagcagaaacccacatcagaaatactcagcacttcagggaagctgaataagggccagctgaacagcctgaaaccaagcaatgtgactgtggacgtttttgtgcagtggttccaagatttgaaggagtgctactcctcaaaacgtcttttctactggtctctatggtgggctttcgccacagcaggttttaaccaggttttgaactatgttcaaatcctgtgggattacaaggcgccatcccaagattcttccatctataatggggccgtagaagctattgcaacctttggaggggctgtggctgcctttgcagtgggttatgtgaaagtcaactgggaccttctgggagagctggctctggtggtcttctcagttgtcaatgccggttctttatttctcatgcattacacagccaatatctgggcgtgctatgctggctatttgatattcaagtccagctatatgcttcttataaccatagcagtatttcagattgcagttaatctgaatgtggaacgctatgccttggtatttggaatcaacacctttattgccttggtgattcagaccatcatgactgtgattgtagtagatcagagagggctcaacttgccagtcagcattcagtttttagtttatgggagctattttgcagtaattgctggaattttcctaatgagaagcatgtatattacctactcaaccaaatcccagaaggatgtacagagccctgctccaagtgagaatccagatgtgtctcacccagaggaagagagtaatatcatcatgtcaacaaaactctaacctcatcgcaacaaacgcaacagtggctttcaaagttatgcaataataaggaaagattttgagatgggtggcatatgttttgccataacttgacatgctttgcaaatctggattccaatggacctttcaaaaccacaacaaaacctcagttttagatgagttctctatgtgaccaattttactggatgcaattgacaggacccgtcatcataattaaacaacccatattggggaccccctgtgactagtagcagctggaaaattctggtttttatcacttgtaaagacatgcagatggcgtggaaccaaaccatgagaaaactccagccatcctggagttgatattcaccatttgtgaggagaaatactaactggactgaccctattgctaggcttaaatacttatttgatcttaccaaagaagtcaacacatgggacctttgtgtcacatgaaccattttctttcctcttctattaagtgtatttctgtttaagttacagttctctaagagaattacaatgtttgtcccatttctaagggcttctcttcaactctaataacagcattattcacgttatgatttgatagtattattatttaatttttttatgattattttccattttgtgctctgagttttgctgttgaaagtctccctcaagaatagcttcagatcctcttgtgtatttgcagaatacacaaggtcatttcccagtggcctgggagaggcagtgagccttctctccaccaccatagacaggtgttaatgcatctatgggccaggtgcagtggctcactcctgtaatccgagcaatttgggaggccaaggtgggagttttgcttgaggccagaggttcaagaccagcctgggcaacacagtgacacctgactctactaaaaaattaaaaaattagctgggcagcgtggtgtgtgcctgtagtctcagctacttgggaggccatggtgggaggatgggttgagcacaggagtcagaggctacagtgagctatgattgcaccattgcactccagcctgggcaacagagtaagactctcatccccctcctcccaaaaaagagcacctgtgtggtgtctgtctaaaataggaaaacttaaaggaggtttctagaagtattagaaataagaaaacactgatggggggagtggaataaaacacctgattttgttttgttttggtttttgagacagtctcgctctctcacccaggctggaatgcaatggcgtgatcttggctcactgcaaacttcacctcctgagttcaagccattctcctacctcagcctcccaagtagctgggactatgggtgcacaccaccacgcctggctaatttttgtatttttagtggagatggggtttcacaatgttggccaggctggtctcaaactcctgacttcaggtgatctgtctgcctcggcctcccaaagagctgagattacaggcgtgagccaccatgcctggccaaaacacctgatttttaaatggtagcaattgtgctaaataaaatgtgtaaaaattttaaagagttgttaacattttttgatgaattctgctgaaaattatctgaacatacctgtttttcgaaacttcaagaaacttcaataagggatgcattgagcagtctgacagtgagaataaagaatgctgagtcaagatttatattaaggctggaagctgtggctcacacctgtaatcccagcattttgggaggctgaagtgagaggttaatttgagggtaggggtatgagaccatcttggccaatatagcaagaccctgtgtctaaaacaaacaaaaaaatttttaattggattttgatatggtttggatctgtgtccccaccaaatctcacgttgaagtgtaatccccaatgttagaggtggggccggctgggaggcgactggatcatgggtgtgaagccttcatgaatggtttggcaccgtcccctcagtgctggtctcatgacagtgagttatcgtgagatctggtagtttaaaagtgtgtagcacctccccactctctctttctcctgctttggccacgtgaagatgcctgctcccactttgccttctgccatgagtaaaaattccccgaggactccctagaagcagatgttgccacgcttcctatatagcctgtgagctaattaaaccccttttcttacaaactaaaaaaaaa

SEQ ID NO: 120 - DNA, 3411 bp, Homo sapiens
actagcgagcgccctgcgtaggcaccggctcctgagcccgtgcttcgggtgagggggcgggtcttccggccctctcgaaaatcatttccggcatgagccggaagaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactccaaaaaaa

SEQ ID NO: 121 - DNA, 2133 bp, Homo sapiens
aaaagggagatgatcctagctagttgacgccaccggtgacctccgacgccccgggcaagagaacgccaggagggataacgggaggaaggccggccggggccgccaaggcagtcccaggctcgcgtaggaggcgcgcagaccttgcaccttgcaccttcgcagcgccctgcaccccgccaccatgtgcgagctgtacagtaagcgggacactctggggctgaggaagaagcacatcgggccctcatgcaaagttttctttgcatcggatcccatcaaaatagtgagagcccagaggcagtacatgtttgatgagaacggtgaacagtacttggactgcatcaacaatgttgcccatgtgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaaaggtggaattgtcagtttagattcataaatgaaaaggtaaatgagtaatcagaataaaccaagtgataatcaaaccatgtcaagattattagttcagactctagcctgttaattttcttagttgatttctgaagctacctgatttattctattaaattgtaagcttgcaaactcaaaataaattggcagatttacctctcatgttttaatgtgtcaaattagagagcaaagtataacaggtgccttcacttttgagacttagtgccttaaaatatgtattctataatgatttcatatataaaagtatatttattgactgtaataaaataaaatatgatgtaaacaaaaaaaaaaaaaaaa

SEQ ID NO: 122 - DNA, 3219 bp, Homo sapiens
aagttggacgccccgacccgtgcgagggccaggtccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcccccggcccccgggggacaagggctccgagagccgtatccggcggcccatgaacgccttcatggtttgggccaaggacgagaggaaacggctggcagtgcagaacccggacctgcacaacgccgagctcagcaagatgctgggaaagtcgtggaaggcgctgacgctgtcccagaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaagagaagcggcagccggggggcgctgggggagaaggaggacaggggtgagtactcccccggcactgccctgcccagcctccggggctgctaccacgaggggccggctggtggtggcggcggcggcaccccgagcagtgtggacacgtacccgtacgggctgcccacacctcctgaaatgtctcccctggacgtgctggagccggagcagaccttcttctcctccccctgccaggaggagcatggccatccccgccgcatcccccacctgccagggcacccgtactcaccggagtacgccccaagccctctccactgtagccaccccctgggctccctggcccttggccagtcccccggcgtctccatgatgtcccctgtacccggctgtcccccatctcctgcctattactccccggccacctaccacccactccactccaacctccaagcccacctgggccagctttccccgcctcctgagcaccctggcttcgacgccctggatcaactgagccaggtggaactcctgggggacatggatcgcaatgaattcgaccagtatttgaacactcctggccacccagactccgccacaggggccatggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcttgtgccttgagtggcagaggagccgtccagccacaccagctttcctcccaccgctcagggcagggaggtctgaactgcggccccagagcctttggcctaagctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatggggggacagacttgatagccaaggtcccttctggtccagttttctgatttagggttctctcaagattaataaaggaagatggggaaatttgactcattaatgagctcgctaacctacgatctggtgataattttgtgtgcacagcccaaggaccacgaggctttctgcactttctgcacccccttccaaagtgaccacaaaatttcaaagggactcatacaatttgagaaaaaacagtcaacctgatttgagaaattaaccagtatggctaactatatcacagaaaatgggattgagttaaaactattttattttaaatatacattttaaagcagttctttttttttgttaatttgtttattatacacacacttcaagagaatatgcacagtctaggccgggcacggtggctcacgcctgtaatcccagcactttgggaggccgaggcatgtggatcacctgaggtcaggagtttgagaccagcctagacaacatggtgaaaccttgtctctatgaaaaatacaaaatttgctgggagtggtggtgcatgcctgtaatcccagctacttggaaggctgaggcaggagaatgtcttgaacctaggaggtggaggttgcagtgagctgagattgcaccattgcactccagcctgtgcaacaagagtgaaactccatttcaagaaaaaaaaaaaaaaaagaatatgcacagtctgaatgtataccaggagtgtgagagacacatgcccacttcatgcaactcctaaactcaaagtctaaatcagatatttttattaacaatgacaacttgttgccaactccctgtttctaatgaccaaagacccagggtacctaaaaggactttgcaaccaagcaaagtcactgtcttcaaatctggatacacactttcccctctgtagattcaaaaggtgcttccttcccggctgtctccagcttccttactctcttttctgggatttctttttctcttctttctgctcttcctccactgctgaactggtccctaactgaaacagcccctgacttatcccaagcatgcttcctttagctgctgtgagaatttgtcttcctcaccagccaggtcctcaggcaaagtcctcagccagtgctttagagcaacttcccgcaaatcagaaactcactgtgattccaaaaatgtttctgagccctggacccctgcccccaaaatattttcatctttcccccaaacctcctttaaaggagcatgcataacagtgtgctgaaagacagttgttggttttttgattttagcatattatttcctgtatgaaatatgttttatataatctcctattatttttatcttatgttttgtattgttgataaatcctttttgtccttctaagatgtcctattgtaaaatcacttataaggtatgattactctttatgctattactttatatgccatttggtaataaatagtaaattgttgatgatatgattgactgatgcgcagtccagagcatgtatgaataatctcataaaacagtatcacagacattaagctaaactgtttcgtttttttgaaagaacaactcatactttggaacagttgtcaatattaatttgttgcaaatatttaatttaaataaacatttttgtaccatgaaaa

SEQ ID NO: 123 - DNA, 3057 bp, Homo sapiens
gaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctatacaactgtgaaatacagatttttacccttttggcattgc

SEQ ID NO: 124 - DNA, 1408 bp, Homo sapiens
gcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagaaaaactgcctgctcttctaaattgtgtgtcccaaaatatttcattaacaagtatcaagtgataatccatggaaaagtgatggaaagtcacaatacaagctggtttgtaaatatttgaatcacattatgggattgctagacagactttcagtcttgcttggcctgaagaagaaggaggttcatgttttgtgccttgggctagataatagtggcaaaacgacgatcattaacaaacttaaaccttcaaatgctcaatctcaaaatatccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgtcgaattccaatcttattctttgcaaataaaatggatcttagagatgcagtgacatctgtaaaagtgtctcagttgctgtgtttagagaacatcaaagataaaccctggcatatttgtgctagtgatgccataaaaggagaaggcttgcaagaaggtgtagactggcttcaagatcagatccagactgtgaagacatgaaaagataatagttggaaacctcagcaattttcaattcaaggaatctatctaagacaaatagaatacattttgtaaaagatgtttatgcatcaaaaaatataattttctgcttgcatttatggactctgacctttttaagaacataggacttcaggtatgctaatttggccattaattatttaaaaactaaatattccctcaaaagggctccctagaattatcaagttcttagtgaaggtctacatttgattgtacgtagaatgtttaaaagtcagttataagccatctcatcccatcataatttatgatatgtttaatatattttattttttaattgtctttttaaaaaatttagtttatgactttgcagtatgaattgtgcttgtgaaaaagaactttaaatatttataagggaccatgggtaattaatatatattcaatttttactatgtgtcactgtcaataaaatgtaaaatataaaaaaaaaaaaaaaa

SEQ ID NO: 125 - DNA, 2840 bp, Homo sapiens
gagacttcctgtctgctcctgcggaatcgcagtttgaccccggaagtgcgggcgctcagggagctgtcaccgtggtcggcggcggcggcggcggcggcggcacagagccggtggtggagccgccgaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgtgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaacgaaaaaaaaaaaaaaaaaa

SEQ ID NO: 126 - DNA, 1615 bp, Homo sapiens
cagtgcgtgctggcccggggtggcaggagccgcagaggcttgggctgcagaaaaaggatcctgtttgctgtgtaatcctgagaatggactgcaagagaggaaaaactgggcgtctgcttgggaatctattgtggaaacccagggtgtttcccgaccagtccctgggcgccaactagagtatggactgaccaggtacctggatggagacctgagctggagaaggagatgcgcttgggaggaaattgcagaggccgtcaacatggaaaagcagccccagaacagcaggagaggcctcgccccccgagaggtgccgccagctgttgggctgctgctgatcatggccctgatgaatactctgctctacctctgcctcgaccacttcttcatcgctcctcgacaatccactgtggaccccacacactgtccctatggtcacttcaggataggacagatgaaaaactgctcaccttggctgtcctgcgaggagctgagaacagaagtgagacagctgaagcgtgttggggaaggagctgtaaagagagtctttctgtctgagtggaaggagcacaaagttgcactctcacagctcaccagcctggagatgaaagatgatttcctccatggactgcagatgctgaaatctctccaaggcacacatgttgtcacgctgcttggctattgtgaggatgacaacactatgcttactgaatatcaccctctaggttccttgagtaacctggaagaaacactaaacctttcaaagtaccaaaatgtgaacacgtggcagcacaggctggagctggccatggactatgtcagcatcattaattacctgcaccacagccctgtgggcacacgggtcatgtgcgactccaacgacctgccgaagacactgtcccagtatctgctaacaagcaacttcagcattttggcaaatgacttggacgccttacccctggtgaaccacagctccgggatgctggtgaagtgcggccacagggagctgcatggggatttcgtggctccagagcaactgtggccctatggagaggacgtgcctttccacgatgatctcatgccctcatatgatgagaagattgacatttggaagatcccagacatctccagtttccttctggggcacattgaagggagtgatatggtccgattccatttgtttgatattcacaaagcatgcaagagccagactccctcagaaagacccactgcccaggacgttctggagacctaccagaaggtcttggatacacttagagatgccatgatgtctcaggcaagagagatgctgtgaaaaccagtccagccaatgaaggtgggattgaagggctgaatggaagttacagcattctactctgatggtggagttttttgcctgagtttcgtgttttattgttttttttatggcttagccatgtggttcgttgtccacatccacatgtacgtttgtatgtagtccacattggttgttagatttttttttttttctttgagatgcggtcttgctctgttgctgaggctggagtgcagtgatgtgatcttggctcactgcagcctctgcctcccaggttcaagcaattctcccacctcagcctcc

SEQ ID NO: 127 - DNA, 4527 bp, Homo sapiens
ctcgctcagcctctccacatcgcggctccggcacctgaagggacgcgggcgggcgcgggcagctccgaccggcggcggcggggcgggacaggcagcccggcggcctccgatggccccgccgtgagaggccggacccgcggcggggaccagcagcggtctagaggagtcccaggagcagccaggacaggcggaagcagtggctgccatggaggaggacaagctcttatctgcagtgcctgaggaaggcgatgccacccgtgaccccggtccagagcctgaagaggagccaggggtccggaatgggatggccagtgagggcctgaacagcagcctctgcagcccagggcacgagcgaaggggcaccccagcggacactgaggaacccacgaaggacccagatgtggccttccatggcctcagccttggcctctctctcaccaatggcctagccctggggccagacttgaacattctggaagattcagcggagtccaggccctggagggctggcgtgctggcagagggggacaatgcttccaggagcctctacccagatgctgaggaccctcagctggggttggatggtcccggggagccagatgtgcgggatggcttcagcgccacgtttgagaagattctggagtcagagctgctgcggggcacccagtacagcagcctcgactccctagacgggctgagcctcacggatgagagcgacagctgcgtcagcttcgaggcccccctcacacccctcatccagcagcgggcccgtgacagccctgagccaggggctgggttgggcattggggacatggcgtttgagggggacatgggggcagctggtggtgatggggagctgggcagccccctgcggcgctccatctccagcagccgctctgagaatgtcctgagccgcctgtctctcatggccatgcccaatggattccatgaagatggccctcagggcccagggggggatgaggatgatgatgaggaggacacggacaagttgctgaactcagccagtgaccccagcctgaaggatggcctgtcagactcagactctgagctcagcagctcggaggggttggagcctggtagtgcagaccctctggccaacgggtgccagggggtcagtgaagctgctcatcggctggcacgccgtctctaccacctcgagggcttccagcgctgtgatgtggcccggcagctgggcaagaacaacgagtttagcaggctggtggccggggagtacctcagtttcttcgacttctcgggcttgactctggacggagcactcagaacattcttgaaggccttcccgctgatgggggagacacaagagcgtgagcgggtcctcacacacttctcccgccggtactgccagtgcaaccctgatgacagcacttcggaagatgggatccacacgctcacctgtgccctgatgctgctcaacacggacctgcacggccacaacattggcaaaaagatgtcctgtcagcaattcattgccaacttggaccagctgaatgatggccaagactttgccaaagacctgctgaagaccctttacaactccatcaagaatgaaaagctggaatgggccattgatgaggatgagctgaggaaatccctgtctgagctggtggatgacaagttcgggacaggcacgaagaaggtgacgcgaatcctggatggtggcaaccccttcctggatgtcccacaggcgctcagtgccaccacctacaagcacggcgtcctgacccggaagactcacgctgacatggatggcaagaggacgccccgtgggaggcgtggctggaagaaattctacgcagtgctcaaagggaccatcctgtacctgcagaaggatgagtacaggcctgacaaagctctatcggagggtgacctgaagaacgccattcgcgtgcatcacgctctggccaccagggcctctgactacagcaagaagtccaacgtgctgaagcttaagacagccgactggagggtattcctcttccaggcaccgagcaaggaagaaatgctgtcctggatcctcaggatcaacctggtggcagccatcttctctgccccggccttcccagccgctgtcagctccatgaagaagttctgtcggcccctgctgccctcctgcaccacccgcctctgccaggaggagcaactgcggtctcatgagaataagttgaggcagctgactgcggagctggccgaacacaggtgtcacccagtcgagaggggcatcaagtccaaggaggccgaggagtaccggttgaaggagcactatctcaccttcgagaaaagccgttatgagacctatatccacctcctggctatgaaaatcaaagtgggctcagatgatctggagcggattgaggcccggctggccactctggaaggggatgacccttctctccggaagacacattcaagccctgccctcagccagggccatgtgactggcagcaaaaccacaaaggatgccactgggcctgatacttagctgacatggatttgcagaccccagggtgggcagatgtctccagtggggtcagtgagcacaattccagccaggggccacttggaccaagctccagtcagttgatgggcagctagaggggtgcagaaagcctgtgggcccaggagatggagatgccgtttgtggcgttgatctccttgcgtccttgggcatctccgggcatcagaccctctccctggcccttgttttcctctccaccatggagcctcattttgtaggccagttgtgtgcatgctctagacaccacctcgctggagaagctggaagggctgttgtcttcccaggtctttctcttctcatcaagctcctctcctcatcttttttgtgtgtgagggcaggtcttgactctaggtctcagctggaaccccaccctttctcctcctccttcctctgagttgaccagcagcaggtctgccgaccaccagcaccatcctctcctcccagcagcctccagaaccatgcccaggtctcctgcctcacatcacaataatctgggacccaggcttgtgccctttcagtgtaaagctgactccatcacatgtgcatccacttcttttcatccattgagatcacactgcctcctttttatacagacacaaatatacatctataagaataatatatacataaggaacccctgaaagatggttttggaactggaatcagttagaggatgaaatcagataaaggaaaagcctattttggagcttcccctgttaggaaggatggctgcacctggccccctggcattcctgacgctctaggagggaagggggaggcagtgctggcctcccttgccctgtttttccctcttccagctgacctgtgacttatactgctcttaccgatgatacttttggaaaaaatagagcgtgtatgcaccgccccgtttgtcccatggatatcctggggtgtgagtcggatgggaccacggccctgtttatatttgggtctttatgttggtgctgccaggtctctgagctccagaggtggcctcttggacagatctactgctataggaataaaagacactctgtctcgcaaatggctgcttgtcaacaagcccaaagatgcttgtcggaggacggttatggaagcccttaattcttggttgtgggaaaaggtggaatgacaagttattgattgtttttctgtcgctatttctttcatttgtctagtgaatcagaaaggcttagccaaggccacatctgggaagagtggagaaatttgccacttgacgatcacggattagctagcacctttaagccctgcatttctccaactgacaagtgggtgggggtgatggcacattcagtgtggctatgaagagcgaatcctctctattgtttaaatagattactgtagtttggccaggaatttggcgtcagtggtaacacacttagttaataaaataagccaggcttgcaactaagtatctaactttacaggcccactcacatttgaggcaaggggctattgagtatgtggagagatgtagtgatttaaattcagattatttaagttggatcagctgaagtgtgttttagacccaaaccatctggccccttcgttttgctcagaggaagtaaatgttcacttaaatgaaattgaaaacgccatgtggcaccacaaaagagctctctgtactttccccatgctgcctcaaaagttctgtgagtttcggggtcagtgtcccacccttcacttcccgagggcgggtgagtggagagcagagccaggagctctggcagctgtggacagatgtgcttcctgagcatgggttgtgcctcccatcagtaaaaaaatgtttagttcacttccttaattgtataattatttatttgtaaattatatacatgtactactgtactaaaatattatgtacattataaaacatacacaaaaatagaaatttaaaaaagatgagatgaaaataaatctaagtcaaagttccaaaaaaaaaaaaaaaa

SEQ ID NO: 128 - DNA, 1484 bp, Homo sapiens
ggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatggcttgtgtttatgctcttcatcattgtgcgttgtgtgcggttacctgcttgagtgatcctgaacttgttgcgacagagggactcactggactctgttcgttatgatttgtctgtttaagagagaaaacaaagtggacttgatttttattaaggctgtttgtttttaagtgttgatagtgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggaaactgaggtccagaaagagcaagcgactttgcttaaagtcgcatcagagagctgagggtaagactcaggtgtcctgactcccagtttagtatcttttgaattttatttctgtaccatttaaaaaaaataattaacactatttgtgcaagtcagtgtttttgaaaattcagtgtcccaataaaaagtggactgcacactaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 129 - DNA, 3261 bp, Homo sapiens
gtgaacgaggcggctgtggcggtggctgaggcggctgggcctagggtgcagcgggcgcgtctgcggctggtgttggcgcatctctagatcctttcccggagttcagttatgggtgtgagaggtttgcaaggatttgtgggaagtacctgcccacatatatgtacagtagtaaatttcaaagaactggcagagcaccaccgaagcaagtatcctggatgtacccctaccattgtggttgatgccatgtgttgtctcagatattggtatactccagaatcttggatctgcggtggccagtggcgagaatacttttctgctttgcgagattttgttaaaacttttacggcagctgggatcaagttgatattcttctttgatggcatggtggagcaggataagagagatgaatgggtgaaacgaaggctcaagaacaacagggagatatccaggatttttcattacatcaagtcacacaaggagcagccaggcagaaatatgttcttcatcccctcagggctagctgtgtttacacgatttgctctaaagacactgggccaggaaactttgtgttctttgcaggaagcagattatgaggtagcttcctatggcctccagcataactgtcttgggattctgggggaagacactgattacctaatctatgacacttgtccctacttttcaattagcgagctctgcctagagagcctggacaccgtcatgctctgcagagagaagctctgtgagagtctgggcctctgtgtggccgaccttcctcttctggcctgcctccttggcaacgacataatcccagagggcatgtttgaaagctttaggtacaaatgcttatcgtcctacacctctgtaaaagagaactttgacaaaaaaggtaacatcatattagctgtgtcagaccatatatcgaaagttctttacttgtatcaaggtgagaaaaaattagaagagatattacctctgggaccaaacaaagctcttttttataaaggaatggcatcatatcttttaccaggacaaaaatctccatggtttttccaaaaacccaaaggtgtaataactttggacaaacaagtaatatccacgagttcagacgccgaatccagggaagaagttcccatgtgttcagatgctgaatccaggcaagaagttcccatgtgtacaggccctgaatccaggcgagaagttcccgtgtatacagattctgaacccaggcaagaagttcccatgtgttcagaccctgaacccaggcaagaagttcccacatgtacaggccctgaatccaggcgagaagttcccatgtgttcagaccctgaacccaggcaagaagttcccatgtgtacaggccctgaagccaggcaagaagttcccatgtatacagactctgaacccaggcaagaagttcccatgtatacagactctgaacccaggcaagaagttcccatgtatacaggctctgaacccaggcaagaagttcccatgtatacaggccctgaatccaggcaagaagttcccatgtatacaggccctgaatccaggcaagaagttttaatacggacagaccctgaatctaggcaagaaattatgtgtacaggccatgaatccaaacaggaagttcccatatgtacagatcctatatccaagcaagaagactccatgtgtacacacgctgaaatcaatcaaaaattacctgtagcaacagattttgaatttaagctagaagctctcatgtgtacaaaccctgaaattaaacaagaagaccccacaaatgtggggcctgaagtaaagcaacaagtaaccatggtttcagacactgaaatcttaaaggttgctagaacacatcacgtccaagcagaaagctacctggtgtacaacatcatgagcagtggagagattgaatgcagcaacaccctagaagatgagcttgaccaggccttacccagccaggccttcatttaccgtcccattcgacagcgggtctactcactcttactggaggactgtcaagatgtcaccagcacctgcctagctgtcaaggagtggtttgtgtatcctgggaacccactgaggcacccggacctcgtcaggccgctgcagatgaccattccagggggaacgcctagtttgaaaatattatggctgaaccaagagccagaaatacaggttcggcgcttggacacactcctagcctgtttcaatctttcctcctcaagagaagagctgcaggctgtcgaaagcccatttcaagctttgtgctgcctcttgatctacctctttgtccaggtggacacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgcatgaaggagaacagacgcatcactggccgagcccactggggctcacaccacgcagggaggtggggaagacagggctccagctaccacaggacgggctctgggtatagccgttccagtcagggacagccgtggagagaccagggaccaggaagcagacagtatgagcatgaccagtggagaaggtactagtcaacctccagaaagagtatggagagaaaaagaggcacacctggacgcagagccctgccagcgccctcctctgctgttgcagctgcaaggagaccatgcctgtgggagccaggcctcgcttgcatgaagaaggaacgatgcctttttcaatggtgtctccctcccattgtgcagaagagcttttgttggcttctctcccgagcttgtgcctgattctgtggcccaaaacaatcattgttaacatcttcatgtgtttcattctgatctttcattcatatatatgatgcctagctaatttcattttaaaataaatgggaatctgttgtattctgattttttattagcaacactagattatgaggggttatctcctgttattaaaaagtcagaaaacactaaaaaaaaaaaaaaaaaaaaaaa

SEQ ID NO: 130 - DNA, 1351 bp, Homo sapiens
ccgccttttccggcgggccccgcttcctcgttgcccccgccgcgggcgcgagatggattccgggtgctggttgttcggcggcgagttcgaggactcggtgttcgaggagaggccggagcggcggtcaggaccgcccgcgtcctactgcgccaagctctgcgagccgcagtggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacctcaagtgacaaaactatcaaatccttctttccacactcaggaaaagactgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggcttctgcttcagtttacccaacctcagcaaacatcgtttgctttggagaggaacttaaggactcagcaggaaattgaagataaaatgaaagggttcagcttcaaagaagacactttgctgttgatagctgaggttatgggagaagatatcccagaaaaaataaaagatgaagttcacccagaggtgaagtgtgttggctccgtagccctgactgccttggtgactgtatcctcagaagaatttgaagacaagtggttcagaaagatcaaagaccatttctgtccatttgaaaatcagttccatacagagatacaaatcttggcttagtgggttataaaaaacaaaaccacaaatatcttgtactgtattaattgtccttgtttacttcagacaggatccattgctaatcatggagtataaatgattatttatgttttataaaactggcttctgtctcaaatgatttctactgcaaaaaaaaaa

SEQ ID NO: 131 - DNA, 2369 bp, Homo sapiens
gtccttcccaagaccacacccaggtccagtcattccctaggacttggcagagagctgtactcacagccaagatcacagcaaaatcagcaaagggaaaaggcatgcagagtgaagtccagaggcaaccagacagaagcatccagaatcctctcacagtggggtcacacaccccatgcttaactcccccaacaatgagttgtaacaacagtcaggtgtggtggtgtgtgcctgtagtcccagctacttgggagcctgaggcaggaggatcacttgagtccagcagttcaagactgcagtgagctatgatcataccactgcactccagcctgagtgacagagtgagactctgtctctaaaatagggctcacctgcttgaggaaacaggaactgcctcggggcagccagccccgccccattgacgtgcagaccttgaatcgaaacccaggctcctgcaggcactggcacagctacagcgagggcctcggccatccaagggtctcccaggtgaccttccctccaccccaggaagctatgacagaggccgggaagctgcccctaccgctacccccacggctggactggtttgtgcacacccagatgggccagctggcccaagacggggtccccgagtggttccatggtgcaatctcaagagaggatgctgagaacttgctggagtcacagccactgggatcctttctcatcagggtcagtcacagccatgtgggctacacactctcctacaaagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctagagaacaggtccaccctggctctgggactcgctgccaggggctgccacactcctgaatgccttaacatttcttccatggccccacaccatggcatccgggggtcttcgggaacccgggaaatggaataaagatgtttttggggtctgttcctgcactcacccatggggtgagctggttattttagcaacaatcatcagagtgacgctgatggtttggggcaccagctatacatcagccccagtgccagaccttctattcattattttacgcctcagagcaaggccctcagggagggtcatcctccatgttttgaagaagagactgaggttcagagaggataagaggcgtgaccaaggccacagagctatgggtgtcagcaccaggatttgaagccaggtgaatccgagcccttttcccatatcatctgtttgttctgttgtctaaaagcacactgcaagccgggctcagtggctcatgcctgtagtcccagcactctgtggggccgaggcaggcagatcgcttgaggtcaggagtttgagaccagcctggccaacatggtgaaaccccgtctatactaaaaaattcaaaaattacccggacgtggtggcgcatgcctgtaatcccagctacttgggagcctgaggcgggagaattgcttgaacccgggaggcagaggttgcagtgagccgagatcgcatcactgcagtccagcctggatgacagagtgagactccatctcaaaaaataaataaataaataaaaatgaaattaaaaaaaaa

SEQ ID NO: 132 - DNA, 1731 bp, Homo sapiens
ttagggcgggagcccggcgagggcgccggtgctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcctcagactgggcgcttctgagggaggaagaaaaggagaaatacgcagaaatggctcgagaatggagggccgctcagggaaaggaccctgggccctcagagaagcagaaacctgttttcacaccactgaggaggccaggcatgcttgtaccaaagcagaatgtttcacctccagatatgtcagctttgtctttaaaaggtgatcaagctctccttggaggcattttttattttttgaacatttttagccatggcgagctacctcctcattgtgaacagcgcttcctcccttgtgaaattggctgtgttaagtattctctccaagaaggtattatggcagatttccacagttttataaatcctggtgaaattccacgaggatttcgatttcattgtcaggctgcaagtgattctagtcacaagattcctatttcaaattttgaacgtgggcataaccaagcaactgtgttacaaaacctttatagatttattcatcccaacccagggaactggccacctatctactgcaagtctgatgatagaaccagagtcaactggtgtttgaagcatatggcaaaggcatcagaaatcaggcaagatctacaacttctcactgtagaggaccttgtagtggggatctaccaacaaaaatttctcaaggagccctctaagacttggattcgaagcctcctagatgtggccatgtgggattattctagcaacacaaggtgcaagtggcatgaagaaaatgatattctcttctgtgctttagctgtttgcaagaagattgcgtactgcatcagtaattctctggccactctctttggaatccagctcacagaggctcatgtaccactacaagattatgaggccagcaatagtgtgacacccaaaatggttgtattggatgcagggcgttaccagaagctaagggttgggagttcaggattctctcatttcaactcttctaatgaggaacaaagatcaaacacacccattggtgactacccatctagggcaaaaatttctggccaaaacagcagcgttcggggaagaggaattacccgcttactagagagcatttccaattcttccagcaatatccacaaattctccaactgtgacacttcactctcaccttacatgtcccaaaaagatggatacaaatctttctcttccttatcttaatgatggtactcttttcaatttctgaaaacagtaacaggcccaacttccttcttactacagtcatattaaacagatcacatcaatgacaaatgtcactactataaaaactacttaatttgtaaggaaattgtttcatagatttaaaaaaattgtggttggagagcatcttggcatttgtgctttttttcttgagggattgttctgcttcctggctgtatgatgggtatatcattaaagtttggagtcctatatgaacaaaactgacatttttagagttgtacttttgggaatgttatagattgatcattctttctcctgataataaaggtattgaatatctgttatgaaaggttct

SEQ ID NO: 133 - DNA, 1353 bp, Homo sapiens
accagggggcggggcctgcccggctggcctggacgaacgggaagccgggagctcggccacgggtggcgaggctgcggtgaggcctggtctccggctgccagaccatgctgagtggagcacgctgcaggctcgcctcagcgctgcggggaacgcgcgcgccgccgtccgcggtcgcccgtaggtgcctgcacgcgtcggggtcgcggcctttggccgaccggggcaagaagactgaggagccgccccgcgacttcgatccggcgctgctggagttcctggtgtgcccgctctccaagaagccgctcagatatgaagcatcaacaaacgaattgattaatgaagagttgggaatagcttatccaatcattgatgggatccctaatatgataccacaggcagctaggatgacacgtcaaagtaagaagcaagaagaagtggagcagcgctagttcataatttaaaaaaattaaaaaaacgcaacagccaacttttcttaataccatataccttttaaaacacagtggcaggtaataagtggaagagaagaatgtttctgtctcttcctacgttgactgttcttattccactggtttctttagcaggactgttctactcagcctctgtggaagaaaacttcccacagggctgcactagcacagccagcctttgcttttacagcctgctcttgcctattaccataccagtgtatgtattcttccacctttggacttggatgggtattaaactcttcaggcataattgatgcaactagagtcaatatgctgtatatattaatgatagctcttgggcatcgatctctgaaagctcaaatggatggaatttagtttgcgggaaagaggctttgctttgcgcatatcaggcttaggactgtgggaggcttaagttgcagatgcttcttttattgtactcttgttctgcccttgttttttgaaggctctgacttataactgctgtatcagaagaaacattttgacagtgtcttggttggagatgaacatccctaattgacatgtgatgactatttcttattccattcatctaagagtcattgaaattttgttttgcttgtttgtttagcttcaaggtctttggtaaagtcacatgttaaggatgactgaaataattccaaaggagtgatgttggaatagtccctctaagggagagaaatgcatttgaacgaatgtgatataaaaccacataatcaaatagaaacttcatgtacttacaaaaactgagtttgtaaaattaccttcatttctttgacattaaatgcttatattagcaataaacatgttgacactttcctataaaaaataaaccagtttgcagtag

SEQ ID NO: 134 - DNA, 1820 bp, Homo sapiens
aggctgtccccaggggcggagagttgcggacccttcccgatccggtaatgggcctgggagatgccagattagcgtggtgcctgtccggagagacgggccagctgatgcccaggtcggggccctgccgctggccacactgggctccggtccaaggctagaaggctggcccctgctgcaacccctctccggctcctctgccacccacctcccggggctggccggctgtggggagccaggcggccgcagtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacggtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgcaccgctgcgggcgtgacgctcccggaaaaaaaaaaa

SEQ ID NO: 135 - DNA, 1696 bp, Homo sapiens
acttaaggagctcgggccagcgcgagggggagcagggaggaagcccggctgctgcggacctcctcggacccggacccagccccagcccggccccagccagccccgacggcgccatgcggggtccgagcggggctctgtggctgctcctggctctgcgcaccgtgctcggtggcatggaggtgcggtggtgcgccacctcggacccagagcagcacaagtgcggcaacatgagcgaggccttccgggaagcgggcatccagccctccctcctctgcgtccggggcacctccgccgaccactgcgtccagctcatcgcggcccaggaggctgacgccatcactctggatggaggagccatctatgaggcgggaaaggagcacggcctgaagccggtggtgggcgaagtgtacgatcaagaggtcggtacctcctattacgccgtggctgtggtcaggaggagctcccatgtgaccattgacaccctgaaaggcgtgaagtcctgccacacgggcatcaatcgcacagtgggctggaacgtgcccgtgggctacctggtggagagcggccgcctctcggtgatgggctgcgatgtactcaaagctgtcagcgactattttgggggcagctgcgtcccgggggcaggagagaccagttactctgagtccctctgtcgcctctgcaggggtgacagctctggggaaggggtgtgtgacaagagccccctggagagatactacgactacagcggggccttccggtgcctggcggaaggggcaggggacgtggcttttgtgaagcacagcacggtactggagaacacggatgaaagtccatcacgaaggcaaacatggaccagatctgaggaggaagaaggcgagtgccctgcacacgaggaagcacgtaggacgatgcgctctagtgctgggcaagcctggaaatgggctcccgttcacaggccccaggacgagtctgacaaaggagaatttggaaaacgggcaaagagtagggatatgttgggttaagaatcagctctttcaaacttggggttttttttgagatgggggtctcaccatgttgcccaggctggtctcaaacccccagcctcaactgatcctcgcatctcagcctcctgagtagctgggatgacaggcgtgcacctggcagctttttcaaagtgttgatggtaatctgaggcaatctaagggagtcattttttaagtgactttatacagaaagattggtaagagccaaggggtagaagtggcataaatgtctaaagcagggaagtgacaggactttcattgttcttggctgaggagaagcgggagtggctgatggaagcacctaaatgatgcctttgtctgtgggaaggcaaatgatgccccagagctctaaccaaaggttttgcagccgccgaaaaacaggaaagttgggaagcgggggtaggactacactgaatcattaacagtgctgtaaactaccatgtggccattaacaatgacctttagggagttttcctaaacgatcactctggtgcgggtgtttggttttgttttaaaatagctttgcagtgaaagctttcatgaccatacaaattatcttttttcttcctatttccttgtagaggtttttttcctccttgtcttaaggtcataaaaatattgttatgtgggaaaaaaaaaaaaaaaaaaaaaaa

SEQ ID NO: 136 - DNA, 3173 bp, Homo sapiens
tgagcccggcggagccctgcagaacccggccgacctccatgggctgcggggggctgcacccggacccctggggcgcggcgcgcccctgaatgcaccgtgggacgcaggagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgctctacaccctcgccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttggggacaagagcctccaccctttgctggcaccctttctggaggcccatgtccggctctcctggcgcctgggcctggacaaacgtcaatcagaggctcggctccaagccctgcaggaggcaggccttacccccacaccaccccccagtctcaaagaattgctcatcaaggaggtgctggactaacccttgcctagatttaaggccactgtgaggagaggggttgccccagaaggcaggggaaggacctgatgagaacagaatagctgggaggctgcagagggtgctgggagcccctagaagttccaaaagagaatgtgaagcagatcaaggaaacttctgttgagctaggctcagggtgagctttggctggggttgcccttgtgtagtacagggaagtctgacacagcctctccagcctataaacagccggggggctgtggcacaggttggggcaatgttcccttgttggtgggcccccaagctggcaaggcctcttggctgaaggccagggactctgcccctggagtcctggagttaagggatgaaggcaaggctgcaggtctggcccaggggaattaaaagccagccactccagtggtatcagtctctttattggatgtgagggccaaaagggactgtaactcctgtctcaggaatggggatagatgggaggttcttgaagccccaggcgaagctggtacctctggctacagcttgctctctgagacctggggcttcactcggatcacgccctcctgggcacaggtcacagctaggactccatcctgacgccacagccgcccatggaccagcccccgagagccacctgtgggtgaggtgaagggtgatgatggcctgcttcagaacagccaaatacactttttttttttttcctgaaacagagtctcactaagttgccaggctggtctcaagcgcctgggttcaagggatcctcccgcctcagcctcctgagcagctgggattacaggcgcacatcaccatgcccaacctccaagtggacttcttgcaaagggtctggcccagggcagggctgccccacacaagggtgcactgagtgtcgtggctgctccaaatgccccttcatgagcttattatggaccgtcattgaggggtaactcctcccacaggaaccccagttgacagtttaaaagcactttcacacctctcctcgcttcctcaaaaagatcacagagggaggagctctgagaacagtctccttcaacagttcggccaagcagaactgctgtacctctgaccacttgtgttaggaaaactatcggctccctgtataataaatcaagccaggtcctccaagtggtaattcatgaaaaatatccccactaccaccaccaaggggaagaaaggactcagaagagaggacttgaggccatgaggtctggcctcttccctccccatctggagactctttctcccttgctggctttgggcccaagtttgatgtttatgaggatgattgctggtttcccttacacatagcagagctcactcagttctcacagtagccaaatgaagcagttatgtgttgtccagttttccagaccaggactgaaatccagagagggtcaggaatttggccccatgatgaagccaaatctgaacccatgtcctcacttcaaggttatcaatcttggattgtgatgctattggtacttgagaataccccttatctgagtataaagaatccttgagttttgtccttggtttatcaagcaaagcttttcttcatttgaaatgtactcccttggaaaggaggtcagggttctgaagctagacattgatgaacgagtcttgtttctctcccctgcaaggaaggtccaagcaggcccttagggaccactgaatgccccgatcccaatcaggttaatcagaatcacttagagaacttaaaaatacagtttcctggaccttatccaagacctactgagtgagaatcttgagggtggaatcagaatctattttgaaaaggcatccccaaatggcagtctgatggactgcgggtttggataccactgctgtaatgtaaccctctttgtttagatgaggaaactgaggttcagatggaagatatgatttgcctattgtaatacaaagaatctgaactgg

SEQ ID NO: 137 - DNA, 3163 bp, Homo sapiens
cggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgcattatggatgatgccatcaacatcctgcagaatgaaaagtctcatcaagtcctagctcaactgctggatactttgcttgcaattggcactaagctaccagagaatcaagctatccaaatgcgattagttgatgtggcctgcaagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacaccaaaaaaaaaaaaaaaa

SEQ ID NO: 138 - DNA, 1524 bp, Homo sapiens
gcgtcaccgaccggtgcggacaggaagaggctctgggctggcacatgtgtatggcggtgaggcgggcgggtacatggcgggctctgtgggactggcgttgtgcgggcagacgttggtggtgcggggcggcagccgattcctggccacctccatagcaagcagtgatgatgacagcctcttcatctatgactgcagtgctgcagaaaagaagtcacaagaaaataaaggggaggacgcgcccttggaccaggggagcggtgcgattctggcgtccaccttctccaagtctggcagctattttgctttaaccgatgacagtaagcgtctgattcttttccgtacaaaaccatggcaatgtctgagtgtcaggaccgtggcaaggaggtgtacagccctgactttcatagcctcggaggagaaggtcttggtggccgacaagtctggagacgtctactccttttcggtgctggagccacacgggtgtggccgtctagagctggggcacctgtctatgctgttagatgtggctgtgagtcctgatgaccgcttcatcctcactgccgaccgggacgagaagatccgagtcagctgggccgcggcgccccatagcatcgagtccttctgcttggggcacacagagtttgtgagccgtatctccgtggtgccaactcagcccgggctgcttctgtcctcctctggggacggcaccctgaggctctgggagtacaggagcggccgccagctgcactgctgtcacctggccagtctgcaggagctggtggacccccaggccccccagaagtttgccgcgtccaggattgcattctggtgccaggagaactgcgtggcgctcctgtgcgacggcactcctgtggtctacatcttccagctggacgcccgcagacagcagttggtgtacaggcagcagctggcgttccagcaccaagtgtgggacgtggctttcgaggagacccaggggctgtgggtgctccaggactgccaggaagcccccctggtgctctacaggcctgtgggcgaccagtggcagtctgttcctgagagcaccgtgttaaagaaagtctctggtgttcttcgtgggaactgggccatgctggaaggctctgccggcgcagacgccagcttcagcagtctctacaaggccacgttcgacaacgtgacctcctacctgaagaagaaagaggagagactgcagcagcagctagagaagaagcagcggcgccggagtcccccgcctgggcccgacgggcatgccaagaagatgagaccgggggaggcgacgctaagttgctgatcgtggcggtctgtttctgtcgactgtggaccacttatgtgcgatccgtggaccacttgcgtgcgatctgtcggccgacgatgagcttgttcggatgtagctccatcgtaagtcgaggagcatctgtgatttgtcctctgcttatgggatatgtttttccgctactgagtctgtgtagtaaatttttgactaggaaaaaaaaaaaaaaaaaa

SEQ ID NO: 139 - DNA, 1973 bp, Homo sapiens
ctttgaaaaagacttcttttgagctaactttcttatactggtacctttctaatctcactacaatatgtaacattggtgttcgatctcaagtatttctgaatatattcccctatccacagaaatatactctgggggaaaaaaaatagaacaaattcttgccgtcctgaccattgaacaagagactaattagacaatggggctagaaaaacctcaaagtaaactggaaggaggcatgcatccccagctgataccttcggttattgctgtagttttcatcttacttctcagtgtctgttttattgcaagttgtttggtgactcatcacaacttttcacgctgtaagagaggcacaggagtgcacaagttagagcaccatgcaaagctcaaatgcatcaaagagaaatcagaactgaaaagtgctgaagggagcacctggaactgttgtcctattgactggagagccttccagtccaactgctattttcctcttactgacaacaagacgtgggctgagagtgaaaggaactgttcagggatgggggcccatctgatgaccatcagcacggaagctgagcagaactttattattcagtttctggatagacggctttcctatttccttggacttagagatgagaatgccaaaggtcagtggcgttgggtggaccagacgccatttaacccacgcagagtattctggcataagaatgaacccgacaactctcagggagaaaactgtgttgttcttgtttataaccaagataaatgggcctggaatgatgttccttgtaactttgaagcaagtaggatttgtaaaatacctggaacaacattgaactagaaactcagaaagtggtccttgtgatggaaagagaaaagaaaaaccaattagaataaggcagaatgtacgtgcgtcattggaacacagaaaacatgctggttcatacagcgtttttagtcataatggtcttttttattttgtttgattcattcgagacaacatgtgtgtatgtgtgtgtgtgtgtgtgtagataatgtggtttttgtatggtgtttgatggaaggaataatctttctttgctttcttagtagtatttcaaggtgtttacttttcaattggtgtgcactgaatgcatgtatggaagaatagcgtgaataatgcaatctctttgtcatttttccccttctcagactcttagctcttaaaattcaaagatgggatattctaactggtagtggtgcatcatttttaacccaaatattgcaagcactttaaagatttgaaaccacatttttattgtttgatgtttcattttcagactttttaatgtcagtcattacaattacattgcatgaggaaaatttttccagaacaacagtgtggaatagttctgaattatgctgttctacagatagaaaaaaagtccaaatgcctttaaaaatttacttcttactccacccaacacgtttttgcaaagcaagaagtctttgtaagacaccttaaacaaagtccttcaattctacagcagaggaaataaaatcccccagaagccaaagggctcaccttcacattgttagttcatgacagacccaggtgtgcttcattagagataacatacattccctttggtatcacaggaagttactggggattactcgacctcattacttagctaacgactggataaaatttcttaattgtttgaagtaacattgtattcgtgtttgcattattaatttgaatagaaaataatcacattttcaacccatttatacaaattgttaatgtttctttagagctgtataactatagtttgaactagcaaggaagttattgttttgacaaccagaaattatgcttttctggtgcatgaaacattaattgcaaagggcagtcacatccaactttaataaaatatggtggtctttcttaaaaaaaaaaaaaaaaaaaaaaaaaaaaaaaaaaaaaaaaa

SEQ ID NO: 140 - DNA, 2139 bp, Homo sapiens
gctgcggcgcgacctcctggctcccgcccgcgctcgccgcacgcacgcgcactgcgcccagcatgagggtcgcggctctgatcagtggtgggaaggacagctgctataatatgatgcagtgcattgctgctgggcatcagatcgttgctttagcaaatctaagaccagctgaaaaccaagtggggtctgatgaactggatagctacatgtatcagacagtggggcaccatgccattgacttgtatgcagaagcaatggctcttcccctctatcgccgaaccataagaggaaggagcttggatacaagacaagtgtacaccaaatgtgaaggtgatgaggttgaagatctctatgagcttttgaaacttgttaaggaaaaagaagaagtagaggggatatcagtaggtgctatactttctgactatcagcgtattcgagtggaaaatgtgtgtaaaaggcttaatctccagcctttagcttatctttggcagagaaaccaggaagatttgctcagagagatgatatcatctaacattcaagcaatgatcatcaaagtagcagctttgggtttagatcctgataagcatcttgggaaaaccctggatcaaatggagccttatctcatagagctttctaagaagtatggagtacatgtttgtggagaaggtggagagtatgaaactttcactttggattgccctctatttaagaagaaaataattgtggattcatcagaagtagtcatacattcagctgatgcatttgcacctgtggcttatctacgctttttagaattgcacttggaggacaaggtgtcctcagtgcctgacaactacagaacatctaattatatatataatttttgaaaagtgttttggaacattgttcattaaaccaccatttctatacaaaaaaattgcatagtattttctcagttactatgactagtttatttttttctcatgactcttatttttttagagaaacatactttcactagaagaggttagtggaaccatttattaattgggaaaatgtcgacggcatgttcattaatagtgccaactttcttggaattcactctttctctttcgttaacacatcttccctatgaccttttttttcttttatttcatctataaaccccatttctgtagcatttctttttttatcacactagtttcttttcctccttctctctttcttgctccaatccctaccaataatgtcatgatgcagaggcatttgaaaatgaagatgaaaagatggtcactttatttagccagtcaagcttattctactgggtgtcgccaaagcgatttatcatttttattttaaatatattcatggttgaagtgtttcaacgttattggacaattaggaagaatgtccttaactcttacaagttattttataactgatttttaaaatgctgtttttcagtattaactatgttgaccttagaaaacttttacaaaaaatagactttatgttttagaacagttttaggttcacagcaaaaatggagcagaaaatgcagagatttcccatataccctctacctccacacattcacagcctcccctaccgtcaatgtcttataatagagtggtacatttgttacaactgatgaacctacattgacacattattatcacccaaagtccatagtttacgtgagggttcactcttggtgttgtacataatatgggttttgacaaatgtgtaatgacatttgtcaaccgttatagtattatacagaataatttcactgccttaaaaaatcctctgtgttttacttattcatccctccctctcctttaacccttagcaactgatcttttcactgtgtacatagttttgcttttaccagaatgtaatgtagttgaaatcatacagtatatagcttttcatgcagtatatagcttttcagattggcttctttcatgtattaatatgcatttaggtttctctgtatcttgtcatgtatatgtagctcattttttttttagtgtagaataaaattttattgtctggttctaccacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 141 - DNA, 2538 bp, Homo sapiens
gtgagcgggcggccggccggacagactgacgtgtgagctgcatcgcgggaggcgcatggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaacattgtagtcatttgtactttgatatcagtattttcttaacctttgtgactgtttcaatattacccccgtgaaagcttttcttaatgtaactttgagtacattttaattgccttctatttttaaaactcaaaatcattagttgggctttactgttcttgctattgtatggcatatacatctgcctggatatatttctactcttgaccaaagttttgtaaagaacaatataagatttcgggtaggggtatggggagggaagatattttattgagaactacttaacaaaagatttatctgtaagcttgaactcaggagtacagttttagctatctagactctaacagcttttgctttaaaattattaaagtgtttcttaatgaaaaagaaaagatcttgctaaagttaaaataaggaacatttcaccttttaaatatttaattcttatgtggacttatttccagaaaactttggtgataattcttgagacaaaaggtggttaagtagcattattatgtaatgcttatataccatagagtttttaatagaagagaaatccatttcctccgagggtcactattaacaatgtacttccttaaatttagtttaatgattgtaatgggtgctgcatttgcacattgcattaagttatgatgagacgaattgttgttaaaaattatagcaaaaagaaatgtaaacttggttaaaatcctttcactctttgtattgttttttttaaggtttttattccttaaatgtaaaatgactacctaattttttgatgtaaatacattaaattcaaagagaaaaaaaatcagctgatgtagcagtatatcttttccttgatggttaaatattgatctagtatttatattgctgaattattttctgtggaggaccagataagcagtaagtatgtcttatcctatatgttttgcaacataaaaatattgctaattgaaaagaattaggcaattatgtgtgttgctgggttgtttttttgtttttttttttttgagacggagtcttgccctgtcgcccaggatggagtgcaacagcatgatctcggttcactgcaacctccatctcctgggatcaagtgattctcctgcctcagcctcctgaatagctgggattacaggcacctgccaccatgcctggctaattttttgtatctgtagtagagacggggtttcactgtgttggccaggatggtctcaaactcctgacctcctgatccacctgcctcggcctcccaaagtgctgggtttacaggcgtgagccaccgcgcccggccaaaattgaggtattttttgccctacgttttaaggactagacttttgaagtattttatagtctagaggtctcaagtaatatatatgtgtttaatatttttagagccaattgataccacaattagataggagtagtgagaataatatggaattacttggtttgaagtagttaaaaattggatatggttatatctgagctgtagtcatattatctcaagaaaaataatacgaggatttaacataagatttgttctattaatgcccaaatttggctttcctctactatcccccatagagaaccactaacaagtggatgtctaatattcctctggtgagttgaaggcaggagaagttgagaatcattagtttcaatgagtatccaggtgacctatcctggccctctactcagaaaccggcaatttgtcttcactctgagattcattaaattgctgttgtataactgatggttattatgaacactgacctgtgagacatatggaagataaagtttggtcttacaggaaatcttgaggagagtcaaaagagaaatgggagatgtctcttgagaggtgatcagagaagtttatgctcactgtctgatgcaaatgtctggtctatttgttagtaaataacagggaaatcattttcactttttgttaaaaataaggtatttacaagcataccttgtagttattgtgggttcagtttcagaccactgcaataaagtgaatatctcaataaagtgaaaaa

SEQ ID NO: 142 - DNA, 3102 bp, Homo sapiens
attggctttccggccggaagctgcggcgcgacccggctgcgcatgcgcctctcacacgtgctgtcagaacgccgcctcctccgcttgcggccggtctgcaccatgctgcgaacgtccgtcctccgcctgctaggacgcacgggggctagtaggctgtctctcctggaggacttcggcccacgctactacagttcgggctccctcagtgccggcgatgatgcttgtgatgtgcgcgcctacttcactacacccattttctacgtgaacgcggcgccgcacatcgggcacctgtactcggcactactggcggacgccctatgccgccaccgtcgcctccgaggtcccagcacggccgccacgcgattctccactggtaccgacgagcacgggctgaagattcagcaggcagcagctaccgcgggcctggccccgaccgagctgtgcgaccgagtctctgagcagttccagcagcttttccaggaggccggtatctcctgcacagatttcatccgcaccacggaggcccggcaccgggtggctgtgcagcacttctggggggtgcttaagtcccgcggtctgctctacaagggcgtctatgaaggttggtattgcgcttccgacgagtgcttcctgcctgaggccaaggtcacccagcagccgggcccatcgggggattcgtttcctgtatctctcgagagcgggcatccagtctcctggaccaaggaagaaaactacattttcaggctttcccagttccggaagccactccagcggtggctgcggggcaaccctcaggcgatcacccccgaaccatttcatcacgtagttcttcagtggctggacgaggagctgcccgacctgtccgtgtctcgcagaagtagccacttgcactggggcattccggtgcccggggatgattcgcagaccatctatgtatggctggatgccctggtcaactacctcactgtaattggctacccaaatgctgagttcaaatcttggtggccggccacctctcatatcataggtaaggacattctcaaattccatgccatctattggcctgccttcctgttaggggccggcatgagcccgccacagcgcatctgtgtccattcccactggacagtctgtggccaaaagatgtccaagagcttgggcaacgtggtggatcctaggacttgccttaaccgctataccgtggatggcttccgctactttctccttcggcagggcgtccccaactgggactgtgactactatgatgaaaaggtggttaagttgctgaactccgagctggcagatgccttgggaggtctcttgaaccgatgcactgccaaaagaataaatccttctgagacctacccagccttctgcactacctgcttccctagtgagccagggttggtggggccgtcagttcgtgctcaggcagaggattatgctctggtgagcgcagtggccactttgccaaagcaggtagcagaccactatgataactttcggatatataaggctctggaggccgtgtccagctgtgtccggcaaactaatggttttgtccaaaggcatgcaccatggaagctgaactgggagagcccagtggatgctccctggctgggtactgtgcttcatgtggccttggaatgtttgcgagtctttgggactttgctgcagcctgtcaccccaagcctagctgacaagctgctgtctaggctgggggtctctgcctcagagaggagtcttggagagctctatttcttgcctcgattctatggacatccatgcccttttgaagggaggaggctgggacctgaaactgggcttttgtttccaagactagaccagtccaggacttggctggtgaaagcccaccggacctagaaactcagttcttaccggcttgtggtaaaaaagcaaatgtgttatctttttattttttattttcaggaaagttatactagtattttcttaagtgtggaatcaaatgagcacataagctgtgtccctgtgaaaagaggtttgtagcctttcaggtgcctgctcctattcatttctctgtgaccattgatcactgtcctttgtgcattgtgtgtctaagatgtcttcaggggaaagatgggtaagagacagtgttgctaatgctgttccttctttgtgcctccttccaaaccacagttatttgcccaaactacctctcgtggctggtttttcattggcctggcctctgcttctcaggctaattagtgactcctttctttgagggtcagggttggaggccccttactggtggttttacagggggatcctactttgttacacatgttgggtttcctgataaaaagagagtattttattaaacccttgaaccagtgtcctagaccagatgatttttgcccatgtgtatccccatttaaattcctacaactaagtctccctgctttgttaatagtccaacagttgggttgtgtaacatcacacttcaaccggtagatggctctaatctcacacatttacttactaaagattgaggattcggaatatttagaataaattagttttctgctttctaattttgcagatctttacatttttattgcttttcttaaaataagggatagctttgcaaccactattgttttaatggaaagcaaaaaacccccccaaacttatcagaatcctcgttctttttcagactactgaaaaatgacatttactctgttaaatgtttaataagtgaataagtaaatgtatcaagttgtttatataataaattataaaactcttgaggcacttggtatgttaaaaattttaaactttagtaacattaggttacaggtatgatttaaaaatttgtaaatagttcaaaagggcaatgttttctttatatttcttatagtcttaattttgttatccatgtgcataatttacctcatgatttcttttggtcaatcaggatctttaatacaatatagaaattgtgtaatagttattataaatgttaatacacaactttcaggtaattttaactgattatttcttttgctcttttaacttaagttattaaagtttaaaagttcgtaagtaaaaaaaaaaaaaaaa

SEQ ID NO: 143 - DNA, 1705 bp, Homo sapiens
tgaccactataaaagtcaggcgggctgaggaggagacaaaggccaggacgctccgcagctgttggggaagaggagctgcctcctgggatggagaaatttaaggctgcgatgttgctggggagcgtcggcgatgctcttggctacagaaatgtctgcaaggagaacagcactgtaggcatgaagatccaggaggagctgcaacgttccgggggcctggaccacctcgtactctcgccaggagaatggcccgtgagtgacaacaccatcatgcacatcgcaaccgccgaggccctcaccacagactactggtgcctggatgatctgtaccgggagatggtgagatgctatgtggaaatcgttgagaagcttccagaacgccggccagacccagctaccattgaaggctgtgctcagctaaagcccaataactaccttctcgcctggcacacaccgttcaatgaaaaaggctcagggtttggagcggccaccaaggccatgtgcatcggcctgcggtactggaagcctgagcggctggagaccctcatcgaggtcagcgtggagtgcggccggatgacccacaaccatcccacaggcttcctgggctccctgtgcacggccctgtttgtgtcgttcgccgcacaaggaaagcccctggtccagtgggggagagacatgctgcgggcggtgcctctggcagaagagtactgcaggaagaccatccggcacacggcagaataccaggagcactggttttactttgaagctaaatggcaattttatttggaggagaggaaaatcagtaaagactcagaaaataaagccatcttccccgacaattatgatgcagaagagagggaaaagacctacaggaagtggagctcggaaggtcgagggggaagacgaggccacgatgcccccatgatagcctatgacgccctccttgcagcaggaaacagctggactgagctgtgtcaccgggccatgtttcatggaggggagagcgcggccacgggcaccattgcaggctgcctgttcgggttgctgtacggcctggacctcgttcccaaaggcttgtaccaggacctggaggacaaggagaagctggaggacctgggcgcggctctctaccgcctgtccacagaggagaagtaaagccatttctgccactttccccctagagagccgattccaccccggggcccgtagggccctctcgcagcccctgggtgagggtgtctctgtgaggctccactgcggtctgtgcctgactggccacatctaactctctgtttccaatttcagaatcctaactgttgcataaaatacattgtttgtcctgcgagaatattttccgtcctccaccatcaacattgacactgcgtagatttgccgcacttggacctccatgcgtggcactcacccgcagtctcctggacaggcgctgtattttattctgtcgcagagctaatgctgtttactcactcacttcaacaacactaactgcggtggtggcctccagcaggcccccccgctgcagaccctctgtcctgcctctgcctccaggcatgcgtttccccgtgagggccaatgcacctccccccaccccccaccctcccatgtccacagtgggtcgtgtgttcctggacagagaaacagtccacactggggcctgcgggacacatatagcagcatattttgctcttaa

SEQ ID NO: 144 - DNA, 2339 bp, Homo sapiens
gggcgcctccgggcctctgcggagccctgggcagctctgagctcgcggaggcgtggccggtgcgcggggcccgcggcgcgcggggatgggggtctcggtggatgtgcaccaggtgtacaagtaccccttcgagcaggtggtcgccagctttctccgaaaggtttccacgctttgagaaggactgaatgagatcatgcgcatggcagcttctctaggatagcaccctgcgtgaacacagtagctgctcagttaagtctttgatgggtgtgatcctgattcagcttgatcaattctgcagtcatactggattgtgtttgaaaaggtgtccagaaaaacctggccatctgcctcctgtcttcccagtaccccaaccccatggataaaaatgtcatctcagtaaaaatcatggaggaaaaaagagatgaatcaacaggggtcatctacagaaagaggattgcaatctgtcagaacgtggttccagaaattttaaggaaggtgagcattttgaaagtacctaatatccaattagaagaggagtcatggctcaatcctcgggaaagaaacatggccatacggagtcactgccttacgtggacacagtatgcatccatgaaggaagagtctgtcttccgggaaagtatggaaaacccaaattggacagagttcattcaaagaggcaggatttcaatcacaggggttggatttctcaactgtgttttagaaacttttgccagcacattcttacgacagggagcccagaagggaattagaatcatggagatgctgctaaaggaacagtgtggtgcccccttagctgaataaagaatcatcagagagctgtatccatgtctacttttttatttatttattttttttttgagaatcacttcttggccacagcacatcacagacacagtttctggaatacaggtttgaggatacagtgttggcagcttcaagaagagaagaccttcttgccaggacataaaatgataccctcctctgggagcctgcttcgaatagtgggactcagggagataagaccttcttgctggatttttatgacacaatctctttataattttacaaataaaggaaaaaagacccatgtaagatatgtgtgcccttcctcagggtgttctgctggttgtctgatgatggtgtcagggcagctaaggacaggataaaggcctggagagggtgcttgtgcccttatgttatcagcaccgttgttcctaggattcgtgaggggattctggaaccaataagggagttgaactggtacctgattcacgggtggactggaacaaacaggaatgtaccagacctatgttgaagctaagccgtatttataacaatgtttaagattctcagaaatcaggagatttttatcctatccataagtaatatgtaactgccataagtatagcttttagaatgtaatatgtaaactgcgatttggtcctctggaaaaaaaaaaatgaaatgaagagtgggaaggcagtttcttttctgctaattcgttctgtgatggtgagcaagcaaatcattaacctctctgttttttattgggcaaatggggataatcaggcacaggtctttccgccaatgcgttatgatgattaaagaaggtaattttgtgcagggttttaagtcaacagacagacctgggtttgaatccaagtgctggcacctacttgctcagtgatcatgaacacaattttaaatctttctgaatctcatttaaaaaaatttgtgaaacaagatgatagaattaattttgtgagattgttggactgatttgagatcatgcctatgaagtacctagcacactgcctagtacatagtagaagtccaggaaatggaagccattattatgtaaaacgttttgcaaaggtactttttaactgtaacgtaaagtggtactactgtttgaaacttagatggcagtagtttgcatttctcgtgatcagaagccaaaatataaatacatactacctaaaaaatcttgaagagaggtaataatttgaaattcatcttcttaagataaaaatcagggcagggtgtggtggcttatgcctgtaatcccagtactttgggaggccgaggcgggtggatcacaaggtcaggagttcgagaccagcctggccaatatggtgaaaccccgtctctactaaaaatacaaaaaaattagctgggcgtggtggcgcatgcctgtaatcctagctacttgggagtctgaggcaggagaattgcttgaactcaggaggtgaaggttgcagtaagctgagattgtgccactgcaccccagcctgggtgacagagcaagactccatcac

SEQ ID NO: 145 - DNA, 2353 bp, Homo sapiens
cgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaacgtgaaaaaaaaaaaaaaaaa

SEQ ID NO: 146 - DNA, 1958 bp, Homo sapiens
cgccaggtggtggctcagaggaggacacagtcgctgtgggcaggtggtcagggcgcaggagggaatgagctgtggatttttagtaatctacaacaatcaggcagttccaggacacagggaagtgagtgtgaacagccaatggacccggagccgagagcctgggcaggcgtaggctggactatggacgccctgcaaccctgccaggctgggaaggggaggcttgatcctgagcgcgtgttaggaaggagatgcccaggttcaggtgtatcgtgcattttttttccacagtgcagaaatgacatttctggttggtcttgaatgtctgctctggccaagccacctcctctcatgctagctaaccaagtggcacgtgtgcccacgcaggccattctaaggaacactgtaattgtctagacaattttctctcaaatactccgtcctggaagcgtctggttggcagaagagggaaggcaggagggtggcagcgtcccggctgagtcctcttgcacatgggagctggagtccagccaggctccagagcggctccggctggcaagggacctgaacaggaagatgagactcgaggttttctgcatgcctggaagtgcacatgctcatctacagctttcttggaagaagaaagaaacaaaaactgagatttagaacaccaggtctgtttccactggcggccactcttgggcactggagaccagcaagagctttgtttttaaaaggctcttccatggcagatattcgcagaggcatcagggctacacttaaatgaagggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatgaaaaaaaaaaaaaaaaaaa

SEQ ID NO: 147 - DNA, 2596 bp, Homo sapiens
agagtcccgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccagttttccccccacgacctgaccgtgtcgctatagtgacgggagggacagatggcattggctattctacagcgaagcatctggcgagacttggcatgcatgttatcatagctggaaataatgacagcaaagccaaacaagttgtaagcaaaataaaagaagaaaccttgaacgacaaagtggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacgtctacaagcacgtgttctgggccacccgtctggcgaagaagcttctcggctggttgcttttcaagacccccgatgaaggagcgtggacttccatctacgcagcagtcaccccagagctggaaggagttggtggccattacctatacaacgagaaagagaccaagtccctccacgtcacctacaaccagaaactgcagcagcagctgtggtctaagagttgtgagatgactggggtccttgatgtgaccctgtgatatcctgtctcaggatagctgctgccccaagaaacacattgcacctgccaatagcttgtgggtctgtgaagactgcggtgtttgagtttctcacacccacctgcccacagggctctgtcctctagttttgagacagctgcctcaacctctgcagaacttcaagaagccaaataaacattttggaggataatcaccccaagtggtcttcaaccataaactttgtgattccaaagtgcccagttgtcacaggtgccataaataattacattttccaacataaatgtgccattttccttgccgcgttaatacaactgagtacaaaagttccaagagagatgctctcttttcaggggctgcaatgtcctctctgagacctagtggtggatgaggtctcctgtttgattttgttcctgcactcactcatttttccagagacccagctgtgattcacaggtgtcagacatggggaggtgtgagccttgcttgctacagcctgtaggatgagtttgacgtggccagcagcaccatctggtcaacctcattccagaatggcacagtcacaagtgaagcatgccactgtcaaatccgagaatgtaaaccgctgaacagctatggatcaaatggtagccctcaaaagatatgttcatgccctaaccctcagaacctataaatattactttatttggaaaagaatctttgcagatagaattaagaattttgagatgggtcattatggatcatcccagtgaacctaatgccatcacgagggttcttatcagagacaggtagagggagatttgagtacagaagacaagatattcgtgtgatgatgcagacagagactggagtgatgccaccacaagccaagcaatgcctggagccaccaggagctgggacaggcaggaaggattctcccttatacccctcagagcaatcttggcccctctgacgtcttgactttagacttctggtccccagaacggagagagaataaatctttcttgttttaaggctccaacaaattggtagtcacttgttacagcaaccacaggaaatgtatacagcttctgatacttctgaaaacctcacacagccaaagggtacatccttggtatagaggctcactcttactcaccagccaggcaaggaaggctcaatcctttggtgttagagagatagatgttgggttttcaaatttcaacatagagaaatcagtcatttgcaatgcttttgagaaagtactgtgtataccctacgagcctgcactccttatgtgtgagactgatgaccattggttggcttattatccattccactaagtgacaaaatcccactgactattcaaatccaggctcctggcatgcctgtaccttagaatcacaaccagctgcaattccaggatggagttcaaactaattgtgggggcatgtgcttcttacatgactgctagattgttcccagatggggaaggttgccctgataagcaacttaaatgaaaataataaatgtattgtttggcctctttaaaaaaaaaaaaaaaaaaaaaaaaaaaaa

SEQ ID NO: 148 - DNA, 1171 bp, Homo sapiens
atctttatccctttaagcatggtttattttctgagcaaggagtcatcatgggagaccttttttccttattttgggaggtagatcctcccccaatacctgtaaattgtgccattccaaatcaggattatgaatgctggaaggatgactcttgtggaaccatagggagcttcctgctttggtattttgttatcgtatttgtcctgatgttcttctctagggcttctgtctggatgtctgaggataaaaaggatgaaggcagtgggacaagtacttcagtaaggaaagcaagcaaagagacttcctgtaagcggcaaagcaaagacagtgcctgggatccctcacaaacaatgaagaaaccaaagcagaaccaacttacccctgtaaccaactcagaagtggctttggtcaatgcctatcctgaacaaagacgagccaggcgccagtctcagttcaatgaggtgaaccagaaccaacatgacagtgatactacggagtatggcagtgaagagtctaactcagaagcctcctcgtggaaggagagtgaaagtgaacaccacccatcaccagacagtattaagaggagaaaaatggctcagaggcaaaggaatctgggaagttaccaaatgagcgaaaggcactgcctccactgcaaagccttgagaaccaacgaatggttggcgcaccattcccgacagaagccttcagtaacaccgccaatgaaaagagacagtcaagaggaaagttccatatctgacattaacaagaaatttagtaaattttgaattttatcacgttcttccttcacttgaagccaaatgaaagagatgaataaaacatgaaaaatcaccagagctataggtgaggagacttttacaacaaagtctctctaccaacaaacaaaaacatacttggaacccaagaggtaaaatctcacacaattcttcgttcaaaaaaaaaaaggccatcacgtgtttatggcaccattggaacaccaaagatctatatctgctatgatttttttatttgaaatagcacaagacagatattttgtgccttgagtgtatatattttgtgccttgagtgtatgtattttgtttatgtctgtaatatgaataagaaagctctttgaaaatgtattatttatgttgagaaaccaaaaaaaaaaaaaaaa

SEQ ID NO: 149 - DNA, 1092 bp, Homo sapiens
aggtgggaggaaaccgcctggagccgccgggagtggacgccgccgaggcccggagtcgcgcctgcagacacagcatctactcagcgtgggtcacctctgtgaacatcactgactgcaagcctccctcaatttctggtgcagcccatcagggacccacagcgcctgggaggatggtgcggatcttggccaatggggaaatcgtgcaggatgacgacccccgagtgaggaccactacccagccaccaagaggtagcattcctcgacagagcttcttcaacaggggccatggtgctcccccagggggtcctggcccccgccagcagcaggcaggtgccaggctgggtgctgctcagtcccccttcaatgacctcaaccggcagctggtgaacatgggctttccgcagtggcatcttggcaaccatgctgtggagccggtgacctccatcctgctcctcttcctgctcatgatgcttggtgttcgtggcctcctcctggttggccttgtctacctggtgtcccacctgagtcagcggtgacctctgagggctgataggggtgggtttgttgagagggacttgctgggccttggtgtgagagcaggcatatttggaggggatctggtggtgccttgaaggtatgatcagagaggggaccacaggtgtgtgtttcccctttgtgttaagcgtgaggcagagggagacgttagtccagcatttccaaagtgtgggtgggtccgttggttcccaagatacttttaggtggtatggggcctgcattaagtggcacaaaatcagagcaagaaagcgatgcccttcccaattctctcaatccttttatgccgagaagatctcagctggatgccaacatgttccgatgcctgtggaagacatgccgacgtctcctctgcctagggagcaggacttgggcttagggcaggtggaaaaaattccagacttttttagcactgtttttgttttaatggtatatttttattggctactttattgtttaggacaagtggtagtggcattctatttattgtgaccttttcaataaatagatttaagtaaaaatgaaaaaaaaaaaaaaaaa

SEQ ID NO: 150 - DNA, 6688 bp, Homo sapiens
atggcatgctgtcacaaagtaatgctgctgctggacaccgcgggcggcgccgcccgccacagccgggtccggcgggccgccctgcgcctcctcacctatctgagttgccgattcggcctggccagggtccactgggccttcaagttctttgactcgcagggggcgcggagccggccgtcccgcgtgtctgacttccgcgagctggggtcccgctcgtgggaggactttgaggaggagctggaggccaggctcgaggatcgcgcccacctgcccggcccggcgcccagggccacccacacgcacggcgccctgatggagacgctgctagactaccagtgggaccggcccgagatcacgtcgcccacgaagccgatcctgcggagcagcgggaggagactgctggacgtggagagcgaggccaaggaggccgaggccgcgctcgggggcttggtgaacgccgtcttcctcctggccccctgtccgcactcgcagagggagctgctgcagttcgtgtctgggtgcgaggcccaggcccagcgcctgccgcccacccctaagcaggtgatggagaagttgttgcccaagagagtccgggaagtcatggtcgcccgaaaaatcaccttctactgggtggataccaccgaatggtctaagttgtgggaatccccagaccaccttggatactggactgtttgtgaactgctccaccacggaggtggcactgtcttgccatctgaatctttcagctgggattttgctcaagctggggaaatgctgctcaggagtggaataaagctgtcaagtgaacctcatctttctccgtggatttcaatgctgccaactgatgccactttaaaccgtttgctctacaattctcctgagtatgaggcctcgtttccacgaatggaaggaatgttatttctccctgttgaagcaggcaaagagattcaagaaacatggacagtcaccctagagcccttggccatgcatcagagacattttcagaaaccagtcagaatttttctaaaaggctcagtggcccagtggtctctcccaacgagcagcactttgggcactgacagctggatgctaggaagtccagaggagagcacagcaactcaaaggctgttatttcagcagttggtaagcaggctgactgctgaagagttacacctggttgctgatgtggaccctggtgaaggccggccccccatcactggagttatttccccactctctgccagtgctatgatcctcactgtgtgccgcaccaaggaggctgaatttcaacgacatgttctccaaacagctgtggctgacagcccccgggacacagcttcccttttctcagatgttgtggatagtatattgaatcagactcatgattcgcttgcagatactgcttctgctgcttctcctgttccagagtgggcccagcaggagcttggccacaccactccctggagtccagctgttgtggaaaagtggtttcctttctgtaacatcagtggtgccagttccgatttgatggagtcatttgggttactacaggctgcctcagctaataaggaagagtcttccaaaactgaaggcgaattaatacattgccttgccgagctctaccagagaaaatctcgtgaagaatccactatagctcatcaagaagacagcaaaaagaaacgaggggtccctcgtactccagtgagacagaagatgaataccatgtgccgttccttaaagatgttgaatgtcgcaaggctgaatgtgaaggcccagaagttacatccagatggcagtccggatgtggctggggagaaaggaatccaaaagatacctagtgggagaacagtggataaattggaagacagaggaagaacactaagaagttctaaacctaaagattttaaaactgaggaagagctgctatcatatatacgtgaaaattaccaaaagactgtggccacaggagaaatcatgttgtatgcatgtgctcgaaacatgatctcaaccgttaaaatgttcctaaaatcaaaaggcaccaaggaattagaagtgaactgcctgaatcaagtaaaaagtagtctcttaaaaactagtaaaagtcttcgacagaatctaggaaaaaaactggataaggaagacaaagttagagagtgccagcttcaggtatttcttcgtttggagatgtgtctgcaatgcccttcaataaatgaaagtacagatgatatggaacaagtagtggaggaggtgacagatttgctgcgcatggtgtgtttaactgaggattcagcgtacctagcagagtttctggaggaaattttgagattgtatattgactctatcccaaagacacttggaaatctttacaacagcctagggtttgtgattcctcagaagctggctggtgtccttcctacagattttttcagtgatgactccatgacacaagagaacaaatcaccacttctttctgtgccttttttgtcaagtgctcgtagatcagtgtcaggcagccctgaatctgatgaactgcaggaacttcgtaccagatcagccaagaagagaaggaaaaatgcattaataagacataaaagcattgctgaggtttcacagaatcttcgacaaattgaaattcctaaagtgtcaaagagagctacgaaaaaagagaactctcaccctgctcctcagcagccttcccagccagtgaaagatacagtgcaagaagtgaccaaagttcgaagaaatcttttcaaccaggaattgctttccccttcaaagagatcactaaagcgggggttgcctagaagccattctgtgtcagctgtggatggtctagaggataaacttgacaacttcaagaagaacaaaggttatcacaaactgctgactaagagtgtggccgagactccagtgcataagcagatctccaaaaggctgctgcacagacaaatcaagggcaggtcctctgatcctggtcctgatattggtgttgttgaagagtcccctgaaaaaggagatgaaataagtctgagacgaagtcctcgaatcaagcagttgtcatttagcaggacacattctgcctccttctattctgtgtctcagccgaagtctcgaagtgtgcaaagagtccactctttccagcaagataagtcagaccaaagagaaaattctccagtccaaagtattcggtctcccaagagtcttctttttggggcaatgtctgagatgatcagcccctcagaaaagggttcagctcgaatgaaaaagcgttcaagaaacactttggattcggaggtacctgcagcttaccagactcccaagaagagtcaccagaaatctctgagcttttctaaaactacaccaagaaggatctctcatacaccacaaactccgttgtatactccagaaaggctgcagaagtcccctgcaaaaatgacccctacaaagcaggcagcttttaaggagtccttaaaagactcctcctcacccggccatgactcaccattggattcaaaaatcactcctcaaaaacgacatacccaggcaggagaaggtacctctcttgaaacgaagacaccaagaactcctaagaggcaaggtactcagccgcctgggtttttgccaaactgtacttggccacattcagtgaattccagtccagaaagcccctcctgtccagcccctccaacttcatcgactgcccagcccaggagagagtgtctcactcccatcagagaccctctcagaacacctccgagagcagcagccttcatgggcacgcctcagaatcaaacacaccaacagccccatgtcctcagagctgctcgggcagaggaaccagcccagaaactaaaggataaagctatcaaaactccaaaaagaccagggaattcaactgtgacttcttccccacctgttacgccaaagaaactgtttacctctcctttatgtgatgtctccaagaagagtccatttaggaaatctaaaatagagtgtccttccccaggagaactggatcagaaagagccccagatgtcacccagcgtagctgcatctctctcctgccctgttccctcaactccccctgaactctcacagagagctacattggacaccgtccctcctccacccccttctaaagttgggaaacggtgtagaaagacctctgatcccagaaggagcatcgtggagtgtcagcctgatgcctccgctactcctggggttggcacagctgacagcccagctgcccccacagactctagagatgaccagaagggactgagcctctctcctcagtctcctcctgaaagacggggctacccaggccctggtctcaggagtgattggcatgcatcctctcctctgctcattacaagtgacacagagcatgtcactctcctcagtgaagccgaacaccatggcattggtgacttgaaaagtaacgtcttatcagtggaagagggtgaggggctaaggacagcagatgctgagaagtcttctctgtctcaccctgggattcccccatctcctccttcctgtgggcctggctctcctctgatgccttcccgtgacgtgcactgtaccacagatgggagacagtgccaggcttcggcacaactagacaacctgccagcatcagcttggcattccacagactctgccagcccacagacctatgaggttgagctggagatgcaagcttctggccttcccaaacttcgaattaagaagatagaccccagctcttcattagaggctgagcccctcagcaaggaggagagctctctgggagaagagagcttcctccctgctctcagcatgcccagggccagcaggtccttaagcaaacctgaacccacctatgtgtcacccccctgcccccgcctctcccacagcacacctggcaagagcagggggcaaacctacatctgccaggcctgtacccccacccacggcccttctagtaccccctctccatttcaaacagatggggttccttggacaccatcccccaagcacagtgggaagacaactccagacataattaaagactggcccaggaggaagagggcggtgggctgtggcgccggctcctcttccgggaggggcgaggtcggtgcagaccttcctgggagcctgtcactgcttgagtcagagggcaaggaccacggccttgaactcagcatccacaggacgcccatcttggaggattttgagctcgagggagtgtgccagctcccagaccagtcgcctcccaggaacagcatgcctaaggccgaggaagcctcttcctggggacagtttgggttgagttccaggaagagagtcctgttggccaaggaagaagctgaccgtggagccaaaaggatctgtgacctgagagaagattcagaagttagtaagagtaaagaggggtctccaagttggagtgcatggcagctaccctccacgggagacgaagaggtgtttgtttccggctccaccccacctcccagctgtgccgtgcggagctgcctctctgccagtgccctccaggctctgacccagtctccgctgctgttccaggggaaaacaccttcctctcagagcaaagaccccagagatgaggatgtggatgttcttccctccactgtagaagactctcctttcagtcgcgctttctccaggaggcgccccatcagcagaacttatacacggaagaagctcatgggaacctggctggaggacttatagccacaaacattactgagcccaaaagatcaaggagtcagccaggaccctgtggacataaagaagttggatgcctggtcccaagcctcttttgccatggtcagtgttcagattgccattagaatgccttagggttttctaattccccttatggatccaatccatctcctggccctgccccttgttggggaagttgcaggaggagaggtggatggcaatgtgattggtgctataactcaggcagcctgggagtcaggaacccagacaaggaatcccattccagcctcaccccaaccatgaccttggcaagtcagggggccactctgcctcatttatgcaaatggagaaaggcgccctccctggggtcccttgagctgctgtaaggctgggctgctgcgacacaggcagcgctttgtaaactgtgaagccatatacgtgaaactgaagagtgcattgggcagtggaagctattttttgccttccctgtgtaacagtaaaatcatctctagtgactgagcactcagtacatttttgtttaatgttgggcctgaggttaactgtgaccatggtccagcttgagtggcttctggagcagccacattttcaaggactgtccaagagccagccagttcagggctcaggcctcacccattgcccactcctggggagaccatcacctggctcatcgtttccaccaagagtgccccacaggagtgccccacagacccgctggaccagcctgctgcgggtcctggccaggggtctggctaacggtgagggctgactctgaactgtctctcagtctccagaaagtgttcaagcctgttgtgttcccaaatctgattcctcctattgtcttgtaaatcaaactctaagtgaaaacttcccatttgtcccttcaaagatttttttttattaaatggttttttaagatcctaaaaaaaaaaaaaaaaaaaaa

SEQ ID NO: 151 - DNA, 2243 bp, Homo sapiens
gggacactggggctgggggggtttgttgggctggtgagttttcgaggtgactgtgctgtgctcggtgaggggacgcccagagagccctgacccggggtcactccgtcgccgttctcctcttgtctacgtgctggacccggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcagaccgcaccttcaacgccagttggtggaatatgagagaaccaagttccaggaaattttggaagaaactccaagtgctcttgatcagactacagaatggataaaagaatctgtaaatgaagaattattttctctttctgagagtgctttaactcctggggccgaaaatacctccaagccaagcctgagccctactttggtgctaaataatagttacttgaaactgttacagtgggattatcagaaaaaagaattaccagagacacttatgacagatggagcacgtcttcaggaactaacagaaaagctgaatcaattgaaaattattgcctgcctgtccctaattaccaacaacatggtgggtgctattacaggaggcctgcctgagcttgcaagcaggttaacaaggatttcagctgttctacttgaaggcatgaacaaagagacctttaacttgaaggaagtcctgaattctattggtattcagacttgtgttgaggttaacaagaccctgatggaaagaggtttacccactttaaatgctgagattcaagctaatcttataggtcaattttcaagcattgaagaggaggacaatcctatctggtccttgattgataaacgaattaagctttacatgagaaggctactttgtcttccaagccctcaaaaatgcatgcctcctatgccaggaggcctagctgtcattcagcaggagctagaagccctaggctctcaatatgcaaacattgtgaatctcaacaaacaagtgtatggaccattttatgcaaatatacttcgaaagctgctcttcaatgaggaagccatggggaaggtagatgcttcacctcctactaactaaagaagaactgacattggacgagagattggaaatccagtactttggtatccagtccacttccattgatggcattagagatccagcacattctcagtactgtggtgcagtattagcccaaatctgtgtaatgggtaatattagcattacagaagacacacacatcacatagaccctcagaagacgtaaacatcacatagaccctatttgtgcatcattttcaagtttaaaacagatatttgtaatgaacagaaaacaatttgtaattaattatattacctatataatacttgtaaatgttttcttaaccatttatatttggcttatgacatttaacccctaaggagttgtttttctcacttgttattatcaaacctaatggtttttaattttggtacaactccttaaagggttgaaggttgtgacaataactgagggaactgatgttctgaataaatgatgtgaagtaaacacaattgtatttgaaaaaaaaaaaaaaaaaaaaaaaaaaa

SEQ ID NO: 152 - DNA, 2369 bp, Homo sapiens
gcggagtggggaggcggcaagaggacctgcggcaggccctcttcggcagtctctccggcccggtttccctcggcgtgctactgtgcgctcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatattaataacaaattatgacaagttaagtttaaataagagttacattattgctctccctgtgtcatattttactaagattttgtgcctcatgtctactgctgaattgtttactaggaatgttaaaaggaattgataattcattttcattttacatttttatataatcaggtaacatgacatacaacttgatgtacaattttgcctgttacaaagggtgtgctaattatagtggtatatgcacagaacatgttggcatgacaacaggctgaataaatagctattttacttaaaaatagctgtgttcttatcagctccctttggactgcaa

SEQ ID NO: 153 - DNA, 2509 bp, Homo sapiens
aaagggtggggggcgggggtagggggagccaatcccggcagcgccaaagaggggaggaggcggtgacagccgcggggagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaaacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgcaaaaaaaaaaaaaaaaaaaa

SEQ ID NO: 154 - DNA, 2886 bp, Homo sapiens
agaaagggtttgactggaggaacctctggagcagctgttggctggctcctctggctgatggcatgttgaggtacatgggccagcggcagcgagggcatccaatccagaggggtccactctagaggccaggccaccagcaccatgggccagtgtgtcaccaagtgtaagaatccctcatcgaccctgggcagcaaaaatggagaccgtgagcccagcaacaagtcacatagcaggaggggtgcaggccaccgtgaggagcaggtaccaccctgtggcaagccaggtggagatatcctcgtcaacgggaccaagaaggccgaggctgccactgaggcctgccagctgccaacgtcctcgggagatgctgggagggagtccaagtccaatgccgaggagtcttccttgcaaagattggaagaactgttcaggcgctacaaggatgagcgggaagatgcaattttggaggaaggcatggagcgcttttgcaatgacctgtgtgttgaccccacagaatttcgagtgctgctcttggcttggaagttccaggctgcaaccatgtgcaaattcaccaggaaggagttttttgatggctgcaaagcaataagtgcagacagcattgacggaatctgtgcacggttccctagcctcttaacagaagccaaacaagaggataaattcaaggatctctaccggtttacatttcagtttggcctggactctgaagaagggcagcggtcactgcatcgggaaatagccattgccctgtggaaactagtctttacccagaacaatcctccggtattggaccaatggctaaacttcctaacagagaacccctcggggatcaagggcatctcccgggacacttggaacatgttccttaacttcactcaggtgattggccctgacctcagcaactacagtgaagatgaggcctggccaagtctctttgacacctttgtggagtgggaaatggagcgaaggaaaagagaaggggaagggagaggtgcactcagctcagggcctgagggcttgtgtcccgaggagcagacttagtggctctgtcccaggagcagcagcaaggatctgccagctgccctgcagccaactgaggaattggaccattttggaaattactgaagatccggatattttctactttacacctttctctgccttgtatctgaaagggctctaaaatgctgtatcatgttttaggcactttcttcatttttttggttattttggttatttcctttttggggggatctcccagaatatttgaacctggttacatgttgtgtatctttttttgaagccttcagatagaataagcctgccatttcttgcacaaatttaggttttttttttgtttttttttgtttttttttttttttttttggtaggggagggcatagagcagggcggggggatgggactgttaggttgaattaacattacaaaatgatacagtgccagatctcagtttcgcatattgtttttcagggcaggtctgtactgtgtgtagtgctgtttacatagatgaatttaggttgtaataattatttttaaagatttacacagatttgaatagcagtgttaactgttaaccacattgcattaattcccaggcgatttagagctcttggagagccaaggccagccaagagcatttgtagtctggtgacaacccccttttaagctaatttatccagaaccctgatttccctcacttcttgctcattccttctttgacctattgcatttcatgttgagtttttccatcaacatgctgcacctgtcagtcaagtgagcattttttaagaacacattgtactgagaaccacttaagcattgaatgcggagaaagcagtgctacctcagttttgctggaagtagacttctttgatagttttctttctttgatgaagtttctgtattttcatgttgtaagtggaaatacttttttttgtttgtttgtttcatttgccttggagccaaagtttctgttcctggtggtcgggaaactgcctgccggccaactgacttgaaggaaaactgtggtatggagctctgcttgaatttttttttttttaatatttttatttttttctttgaatatcatcagcttacttgtctggcaagggcagaagcctggggttggcctgaactctgccaaacaaatatcaaagtgtatttaatagttaaatttgtgccctttcccttcttgctgcacccatgttgtcacttaacccccaggagttatttattatctttttgttaaagtcaggctcatttggggtaatgtgatgactgtttaggtttacatgaccctcctctcctttccctacccccaaatatgtatatatacatatataaaatatgtatatattttacctatataaaatatatatatatacacatatatgtatctatattcctttgtttctttgcctgcttatactggccataaaagagggagctgccttcaatgtataaagtataagaagagtgccagggaatgccataatggaggcttttggatctgaatttggaccatttcactaaagagaacatgagtttgctcagccctttcctcacaagagggagggccccggttccccagacttctccacgcgctggctccataaaggccagctttggccaggctgccacaggggcctgaggagctcactctgggcctacctggtttcagttagagggtcctcctgttatttttccatttaaaaagtatgtcctcagaaaactgtactggaaggatgggtggcaggaacttgtatagttcagcttccaacactttggaacagattaaaaagggaatcttttaaataaaaacgtataaaaataaaaaaaaaaaaaaaaaaa

SEQ ID NO: 155 - DNA, 1294 bp, Homo sapiens
accagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcggaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaa

SEQ ID NO: 156 - DNA, 2087 bp, Homo sapiens
ctcccaggtgcctggcagagagtcctcaccagccccctgccggatgtctggctggcatctgaggggactgaacatggcaagaagcaaaacagcagcacaagaaaccagtttcttcatctgaaaccgagcaggctctactccagaacagaacccacagtcccaggcgctgggccttcttcttaagttgggaaatcactcatccccaggagaaaaaaagagcaaaagcttccagtactggggatgtggggagaggttttttaaaaatatcagcccaatatatgggaaaatatgggatgcaggcatccccaggtgtcaagcgtccagatccgtagacacactgggacgatggtgatcagtatcactccctctgactcatcggccctacagagaagacaccatgctggtgcacagtcggtgccaaacccgcgtttgtaaatgaataagtgttgctgccctggtggaagcccagctcatgtggaggaagccagcttgcagagagagcaagaacagagccagcacacacattggagcaaaggcaagggcagatggaaagttctggcggcatcatgccaaggctcccatccgaggcctccctgaaccccactctctcggcgccaccttggatgctgcgggctggtacattccccacttgcaaaactctgtggggctgggttcctctcttttctttccaaatatcccaggaagtggatggttttatccaaattcagcagacgagtaaaaagagtcttcgggaggtgcaatagctttctaggaatgaggatattcttcaaggaaaatgaaccccacactaggcctggccatttttctggctgttctcctcacggtgaaaggtcttctaaagccgagcttctcaccaaggaattataaagctttgagcgaggtccaaggatggaagcaaaggatggcagccaaggagcttgcaaggcagaacatggacttaggctttaagctgctcaagaagctggccttttacaaccctggcaggaacatcttcctatcccccttgagcatctctacagctttctccatgctgtgcctgggtgcccaggacagcaccctggacgagatcaagcaggggttcaacttcagaaagatgccagaaaaagatcttcatgagggcttccattacatcatccacgagctgacccagaagacccaggacctcaaactgagcattgggaacacgctgttcattgaccagaggctgcagccacagcgtaagtttttggaagatgccaagaacttttacagtgccgaaaccatccttaccaactttcagaatttggaaatggctcagaagcagatcaatgactttatcagtcaaaaaacccatgggaaaattaacaacctgatcgagaatatagaccccggcactgtgatgcttcttgcaaattatattttctttcgagccaggtggaaacatgagtttgatccaaatgtaactaaagaggaagatttctttctggagaaaaacagttcagtcaaggtgcccatgatgttccgtagtggcatataccaagttggctatgacgataagctctcttgcaccatcctggaaataccctaccagaaaaatatcacagccatcttcatccttcctgatgagggcaagctgaagcacttggagaagggattgcaggtggacactttctccagatggaaaacattactgtcacgcagggtcgtagacgtgtctgtacccagactccacatgacgggcaccttcgacctgaagaagactctctcctacataggtgtctccaaaatctttgaggaacatggtgatctcaccaagatcgcccctcatcgcagcctgaaagtgggcgaggctgtgcacaaggctgagctgaagatggatgagaggggtacggaaggggccgctggcaccggagcacagactctgcccatggagacaccactcgtcgtcaagatagacaaaccctatctgctgctgatttacagcgagaaaataccttccgtgctcttcctgggaaagattgttaaccctattggaaaataaaggagaattcctgcttgccaaaaaaaaaaaaaaaaaaaaaaaaaaa

SEQ ID NO: 157 - DNA, 2039 bp, Homo sapiens
gataaacaagctcctgtggaattgtgggtagacactggacttgtaaacgaaaagcttcataagtccctctttgcttagtacttttctcgtcctttccccagggtgcacgtaaccctcaagcactaggaccgtgcggaatccaggctgcgatggcaccttcatttaccgcccgcattcagttgttcctcttgcgggcgctaggctttctcataggcttagtaggccgagcagctttagtcttagggggtccaaagtttgcctcaaagacccctcggccggtgactgaaccattgcttctgctttcggggatgcagctggccaagctgatccgacagagaaaggtgaaatgtatagatgttgttcaggcttatatcaacagaatcaaggacgtgaacccaatgatcaatggaattgtcaagtacaggtttgaggaagcgatgaaggaggctcatgctgtagatcaaaagcttgcagagaagcaggaagatgaagccaccctggaaaataaatggcccttccttggggttcctttgacagtcaaggaagctttccagctacaaggaatgcccaattcttctggactcatgaaccgtcgtgatgccattgccaaaacagatgccactgtggtggcattactgaagggagctggtgccattcctcttggcataaccaactgtagtgagttgtgtatgtggtatgaatccagtaacaagatctatggccgatcaaacaacccatatgatttacagcatattgtaggtggaagttctggtggtgagggctgcacactggcagctgcctgctcagttattggtgtgggctctgatattggtggtagcattcgaatgcctgctttcttcaatggtatatttggacacaagccttctccaggtgtggttcccaacaaaggtcagtttcccttggctgtgggagcccaggagttgtttctgtgcactggtcctatgtgccgttatgctgaagacctggcccccatgttgaaggtcatggcaggacctgggatcaaaaggttaaaactagacacaaaggtacatttaaaagacttaaaattttactggatggaacatgatggaggctcatttttaatgtccaaagtggaccaagatctcattatgactcagaaaaaggttgtggttcaccttgaaactattctaggagcctcagttcaacatgttaaactgaagaaaatgaagtactcttttcagttgtggatcgcaatgatgtcagcaaagggacatgatgggaaggaacctgtgaaatttgtagatttgcttggtgaccatgggaaacatgtcagtcctctgtgggagttgatcaaatggtgcctgggtctgtcagtgtacaccatcccttccattggactggctttgttggaagaaaagctcagatatagcaatgagaaataccaaaagtttaaggcagtggaagaaagcctgcgtaaagagctggtggatatgctaggtgatgatggtgtgttcttatatccctcacatcccacagtggcacctaagcatcatgtccctctaacacggcctttcaactttgcttacacaggtgtcttcagtgccctgggtttgcctgtgacccaatgcccactgggactgaatgccaaaggactccctttaggcatccaggttgtggctggaccctttaatgatcatctgaccctggctgtggcccagtacttggagaaaacttttgggggctgggtctgtccaggaaagttttaggaggaccttctgcaaggttaatgtgtgtgtgtgtttgtgttcgtgtggtggtgtttctattaattgggtgaaatcaagcaccagcagacaagcagagaaacaactggggaatttattgactcatttagttattctttctacttttatttccttctctaactgttggtcttactaaaatggtaatatttgcttcttgcttttatgttactggaaaattaggacatgtaaatggataagtgcaataaagtttcctaaatgctggaaaaaaaaaaaaaaaaaaaaaaaaaaaaa

SEQ ID NO: 158 - DNA, 2858 bp, Homo sapiens
cttaaagccctgaccgtcgttctccgtcctcctctgggtaccaactctattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggagactgctttccagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccagcacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaaaaaaaaaaaaa

SEQ ID NO: 159 - DNA, 4548 bp, Homo sapiens
gtcacttccggcgggggcgcggcttggactgaggagcggacccggccgggcgcaggggctggactggcggagcaggtggggtccgcggccgccggagcgttccggtcggcgtctgggcatctcggcctcggcagaaagcgcgaccgccctgctgcgcggggcccgcggcgatgccgttcctgcacggcttccggaggatcatcttcgagtaccagccgctggtggatgcgattctgggctccctggggatccaggaccccgagcggcaggagtctctggaccggcccagttatgtcgccagcgaggagagccgaatccttgttctcactgagctgctggagaggaaagcccactctcccttttaccaggaaggcgtgagcaacgccctgctcaagatggctgagctggggctgacgcgggcggccgacgttctcttgcggcatggggccaatctcaactttgaagacccagtcacctactacacggccttgcacatcgccgtcctgcggaaccagccggacatggtggagctgctggtgcatcacggggccgacgttaatcggagggaccgggaaaaactgctctgctccatgctctggccagcagcgacggggtgcagatccacaatactgagaacattcgtctcttactggaaggaggggcagacgtcaaggccaccaccaaagatggggacacagtgttcacctgcatcatcttcctgcttggtgagaccgtgggaggggacaaagaggaggcccagatgatcaaccgcttctgcttccaagtcacacggctgctgctggcacacggggccgaccccagcgagtgcccagcccacgagtccctcacccacatctgcctgaagagctttaaactgcacttccctctcctgcgcttcctcctggagtccggagccgcctacaactgctccctgcacggtgcgtcctgctggtctggctttcacatcatctttgagaggctctgttcccacccaggctgcacggaagacgagagccatgcggacctcctgcgcaaagctgagactgtcctggatctcatggtgaccaactctcagaaactccagctgcccgaaaacttcgatatccaccctgtgggcagcctggcggaaaagatccaggccctccacttctccttgaggcagctggagagctatcccccgcccctcaagcacctgtgccgtgtggccatccggctctaccttcagccgtggcctgtggatgtgaaggtcaaagccctgcctctgcccgacaggctgaagtggtacctccttagcgagcacagtggctccgtggaagatgacatctgataggtctcaggctacaggaacgggggacacgggcagctcaggtcagcctgttggtagatgctgggacagcattagaagagggtctttttgatctgggagatgagacgggatccttcatgagaaaagccagccaggtagagcctgaagctgtgatcactccagtggtgaagggtgcagctctggttcttccagagagactgcccccttccctccagcggcactccaagtcccccccatgttggaaagaggaacagggcttggattgatgtttataccctctgaattggagggcagtgccagggcatttgcagaagctgggaaggaccaagcctcagcaccccagggctgcggggctcttgttggccgcacgtggcagtgcagctggagaggaagcctggggcacgtcctgtgcggtgccaccaaggccccacccctgccccttttccttccaggttctgttactcacagaagtgtttctggtgggctctgcgggagaagacactaagggccccacaggcttgtttcatggtgttgcaagccaagctggcccctgcctgttcctgtagctctggggccaggtcagccgtggccccacctaccagaactgtgctctgctggcagctgtgcttttgccaaacccagggcctcagcgaccatgacttctgctaaaaagcaatcatgagtgcgtggctggggacagacctctctgaagtgtctcctgttgtgaggggctcactttggagccactgaagagccgactgtgccacccacttgcgagcctcagtcccttccaagctgcactggtcattgggaattgtgtaaacacctctggggataagctgaggtgactaaatgatatatttatattataagattaaactgactttcttggccttaacaaggtccttatataaaatttccaccccgcccctccatagttcaggatagaggctcccacagcagccggtaaggaagtgggtggcaggtgtgaggggatgctgtgtttggggggttgtttccaagtccctgcaaagaagcaccactctagactggcaagggcctccacagtgtggaggtcccattttattatttttttttttcgagacactctgtcacccaggctggagtgcaatggtgcaatctcggctcactgcgacctctgcctcccaggttcaagcagttctcctgcctcagcctcctgagtagctggcattataggtgcccaccaccatgcctggctgatttttgtatttttagtagagacggggtttcgccatgttggtcaggctggtctcaaactcctgacctcaggtgattcgcctgcctcggcctttcaaagtgctgggattacagacatgagccactgtgcccggcccccattttattttagttttattttgagacagagtctcgctctgtcacctaggctggagtgcagtggcgcaatctcacctcactgcaagctctgcctcccgggctcaccccattctcctgcctcagcctcctgagtagctgggactacaggcgcccgccatcacgcctggctaattttttttttttttgtattttaagtagagacggggtttcacctgttagccaggatggtctcaatctcctgacctcgtgatctgcccgcctcggcctcccaaagtgctgggattacaggcgtgagccaccgcgcccagccccattttattttttactttaaatgcctgccaaggagcagcctcaagcccagagaagactgaggctacggggaacttcccttgctgcaggctgttgtaacactttaagggccccaggtctccactgccaagcaggacttggcacatgagcacccaccccacagcaccatcaggcagcacccatgggctccaccagcccagctctgtccctcccctaggtaaagatcacactgaagtcttcaagtccccagcaaccaagttgggggtggtttccttcctcttcaggcagccaggcccatggctggaaggccgggctggaggcccagggaatcggttactgatgtggccaccctattcccacatggggagcaccaggagccctggagccccttccacccaatcccatctcgcaggagagcagggtctgggctcctgcctcaccgctggttcagcagcaccctccccgccgggtcccaccttgccttttgaagaagagcccgcataatgagtggacggcagacagctatatttagtggtgcctcgacactcacgaaccgccagcgtggcgcctggatcttgcccagctgccagctccccccaccaggactgtggttcctcagtttctcctgccagccccggctcatctcagggcaaagctatagacatggtagatctcatcggggaggttctcctgcctctcctcggccaggaggctgaggcctgcactgcagatgatcctgcggaccacgtcaaggtcccggcacacgctgctgtccacgtcgtccagaatcacgccctcctgggccatgttgtctttgatgacgatgatgccgttggggcggaggctgcccttgcagcgccgcaggaactcggccaggtgctgatcggtgaggtggcctggggagggcagaggcaaggttaccagggcaccatgcaagcggatgtcggcactggatgggatgtacttctcagccccgctgagcccctcatttgtgcccagcattttgtgtgcacacatggcctcattggctctcagtcccgagagatttactaaaccccaattcatagaataggaaactgtggctcagaggtcatctacctaaagacacattaagccagaatttgacttgacgggatggcttacaagtcctgcctgatacctacacaccatgatgccccacccctgccaggcttggatcggaggagtgaacctgggctaagagtttggcattgcaggagctcccagagagactgccttccctacactagaagtccccacaaaggcttctgagaccacaaaatacaaggccagacctagagtgtccacagcaggcctgtgctgcccgcctcaggaggtggccgactgctgctagcggcctgccgccacgtcagcagcccagggcacagcgctcgaggtgtgctgttaggctaagagggtgcagggctagacacgaagcttaaactattcatcttattaaaaataaaacccttataaaactccaaaaaaaaaaaaaaaaaaaaaaaaaaaaaaaaaaa

SEQ ID NO: 160 - DNA, 3818 bp, Homo sapiens
tgtggtgcgaagccacctcccccgccgaatcgcgcatctgcgcagttgctgttattgtgacttgtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctggttttttgccctgacatctcttcgtcttgtgtttttacttgcatttggcttgatgatcattgtgtgtattgatcaatggaagaacaaaatctggcctgaaataaaagtgccaagacccgacgcattagacaatgagagctggggctttgtgcaccctcggttgctcagcgtgcccgagctctgccaccatgtagctgaagtctgggttagtgggaccattttcataaggaatgttttgcttttcaaaaagcaaaacccaggcaagttctgcttgctgagctgtgggatactgacctttttggctgtcttgggccgctacgtccctgggcttctgctgtcctacttgatgcttgtcactgtcatgatgtggccccttgctgtgtaccaccgactgtgggatcgagcatatgtgcggctgaagccagctctgcagcggctagacttcagtgtccgtggctacatgatgtccaagcagagagagagacaattacgccgcagagctctccacccagaacgagccatggacaaccacagtgacagcgaagaggagcttgctgccttctgtcctcagctggacgattctactgttgccagggaattggccatcacagactctgagcactcagacgctgaagtctcctgtacagacaatggcacattcaatctttcaaggggccaaacacctctaacggaaggctctgaagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgaacttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcagtcactgaagtgagagtgtgctcccccaagggaggcttctctccatcaggatggtactttgggggaacaaaatagtcagggatattggttcccctttgaggaggtgctgctgtttgcttttaggtatgagtgctcaggggccctcactgaaagagcccatgcctgccttcctcctttcatcgcctctctagagcccccaaagtcaggcagcagctggagtagttacattgtcatcatctttttttttgagacagtttcgctctgttgcccaggctggagtgcagtggtgtgatcttggctttctgcaacgtctgccttccaggttgaagaggttctcctgcctcagcctccttagtagtgggattacaggtgcccgctactatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttctttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttaaagcaaacttgtcctttggttttgcagaacaggcctgctccctctcatctagcccatcatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatcttcggtttctgataacccctgggtccatctggccatcagcctcagcagtgagcaaagcaataccatactcatttctatgttcctgttccttcctctgctcctcctttggagaagcaataattcatgggggatgatacagtagcactttacaaatggctccatgtcattcatcccaggggccataatctcttgcaccacctattcttacttcctgttcagctcctttacagcttttattttcaactgcttcccaacttggtggggcctcctttaaggatgagccaatagtaagaatgtggctgtaatcagcagagacccctctgaggggtatctgttctgcagcccctagtgaaatcatgtgatgtgagacagaaacctaaacatggtacttgattctaaacctgtgccagtctatagcctctgcctccccaagcagagctcaagccaaacgcttctgtcctctttccttctgcattaaccctttgctgatcctcaggggccactcccccaacacccctgtacttgggtgagggatgttggacagagcctgttttcatgtactgcaggtgggggtgtgctgacatgtttgctcttggttgatggagaaggtacagaggccagggagtgaaaatggttgacagaagagggaagagttaggtgtctcatagtcactcatagtggggtggtcaggggtaatggcatctccccactttaggcttctcaaacagacttttgacacctctcaagttcagagctctgatgtggaaagacaggaggtgtggggaaggagggggatttcgtgtgtttgcatgagtgtgcgcttcaggccttgggagttggcaagagggagggaaggaaggagagcaaaatcttcggaaggtgtttcttgtacctgagggatcctgccctgaatctccatagtctccactgtgaactgaggaggggaggggtgtgctggggaataaatcttgtatgagaacaatctttaaaaa

SEQ ID NO: 161 - DNA, 694 bp, Homo sapiens
gcagctgccaggatgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcgaggccagcactgtgacacatggtcttatgtgctgataccggcagcccagcctgggcagttcactgtggaccacggtgtggagcccggggcggacagagaggagacccgggtggtggacagcgactacacccagttcgccctgatgctgtcccgcagacacacgagcaggctggccgtcctcaggatcagcctgctgggcaggagctggttgctgcctcccgggacgctggaccagttcatctgcctgggcagagctcagggcctctcggatgacaacatcgtcttcccagatgtgactggctggtcaccccaggccagcgtctgttgaaggatgaagcagctcctgtccggcccagccctgcctcacagctgtgcgagctctgccctcctcagctctcaaacctgaataaatgcaccaagcccagaaaaaa

SEQ ID NO: 162 - DNA, 940 bp, Homo sapiens
cctgggcgtgtgctaaggccagagctaccagatgggtccagctgccgcaggctctccaggcactgtcccctaagtgacagctgttactgcctgggagagctcaagtgcaaagactatcctgttctcccataaagaggaggaaaaggaagatacagaaatcggtgctgctcccaacagcagatcaaggcagtcgtcaggaactcaggatccggggggtcttcacggcttctctgcccaggggccagaaccgaggaggccaggagggctgctggggctaaggggtctaaggacctcgttgcacacgctaccaggagcaggggcatggagcacagtgagggggctcccggagacccagccggtactgtggtaccccaggagctgctggaagagatgctttggttttttcgtgtggaagatgcatctccctggaatcattccatccttgccctggcagctgtggtggtcattataagcatggtcctcctgggaagaagcatccaggcaagcagaaaagaaaagatgcagccaccagaaaaagaaactccagaagtcctgcatttggatgaggccaaggatcacaacagcctaaacaacctaagagaaactttgctctcagaaaagccaaacttggcccaggtggaacttgagttaaaagagagagatgtgctgtcagttttccttccggatgtaccagaaactgagagctagtgagggttcagagaagccccatcctaagccagacacatgatgtgggctcagctcagtggcctgaaacctctcaggttttagagtctctcccaagaagccgcttttttctttttctttctttctttttttttttcttagcagatacaatgaatgaactgcaagcaaactaaaattctgttattaaaaaaaatcttttattaaaatgctcctggaagggagcaggtggtattgc

SEQ ID NO: 163 - DNA, 5703 bp, Homo sapiens
gcgcggctcggagaggcggcggcagcggcggaagcggcgagggcggcgggcgtccggctctgaggtggtggaggcggcggaggcggcggcggaggcggcggcggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaatcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggagtcttaccgccagataatgaagatgcgaccgaaagacttgaaaaaacggctgatggtgaaattccgtggggaagaaggtttggattacggtggtgtggccagggagtggctttacttgctgtgccatgaaatgctgaatccttattacgggctcttccagtattctacggacaatatttacatgttgcaaataaatccggattcttcaatcaaccccgaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctagagaacgacatcacgcctgtactggaccacaccttctgcgtggaacacaacgccttcgggcggatcctgcagcatgaactgaaacccaatggcagaaatgtgccagtcacagaggagaataagaaagaatacgtccggttgtatgtaaactggaggtttatgagaggaatcgaagcccagttcttagctctgcagaaggggttcaatgagctcatccctcaacatctgctgaagccttttgaccagaaggaactggagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggttctacaggcgcggcagggccccggctgttcaccatccacctgatagacgcgaacacagacaaccttccgaaggcccatacctgctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgactttacatttaaaaaaaaaaaaaaaaaa

SEQ ID NO: 164 - DNA, 1257 bp, Homo sapiens
taggtggcgggcgggtacttaaggcgcggccaccgcggctgcggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaaaaaaaaaaaaaaaaaaaaaaaaaaaaaaaaaaaa

SEQ ID NO: 165 - DNA, 6556 bp, Homo sapiens
gcaggcgcggggcgcggggcaggcagagcgggcgaaggcgcggagctcgcagtgcagcccgcgcttcccagcgtccgtgcccggccgcctgtgcctaccgtgcccgtggcgccatggccgctgccgccctcccgccccggccgctgctccttctgccgctagtgctgctgctgagcggccgccccacgcgcgccgacagtaaggtgtttggggacctggaccaggtgaggatgacctcggagggctccgactgccgttgcaagtgcatcatgcggcccctgagcaaggacgcgtgtagccgagtgcgcagtgggcgggcacgcgtggaggacttctacacggtggagactgtgagctcgggcactgactgccgctgctcctgtaccgcacctccctcctctctcaacccctgtgagaacgagtggaagatggagaaactcaaaaagcaggcgcccgagctcctcaagctgcagtccatggtggatctcctggagggcaccctgtacagcatggacttgatgaaggtgcacgcctacgtccacaaggtggcctcccagatgaacacactggaagagagcatcaaggccaacctgagccgggagaatgaggtggtgaaggacagcgtgcgccacctcagtgagcagttgaggcactatgagaatcactctgccatcatgctgggcatcaagaaggagctgtcccgcctgggcctccagctgctgcagaaggatgccgccgccgcccctgccacccctgccacgggcactggtagcaaggcccaggacacagctagaggaaaaggcaaggacatcagcaagtatggcagtgtgcagaaaagctttgcagacagaggcctcccaaaacctcccaaggagaagctgcttcaggtggagaagctgagaaaggagagcggcaagggcagtttcctccagcccacagccaagccccgcgccctggcccagcagcaggctgtgatccggggcttcacctactacaaggcaggcaagcaggaggtgaccgaggcggtggcagacaacaccctccagggcacttcctggctggagcaactgccgcccaaggtggagggcaggtccaactccgcagagcccaactccgcagagcaggatgaggctgagcccaggtcctccgagcgagtggacctggcttctggcacccccacttcaatccctgccaccaccaccaccgccaccaccaccccaacccccaccaccagtctcctgcccaccgagccaccttcaggtccagaagtctccagccaaggcagagaggcgagctgtgagggcaccctccgggctgtggacccccctgtgaggcaccacagctatgggcgccacgagggagcctggatgaaggaccctgcagctcgagacgacaggatctatgtcaccaactactactatggaaacagcctggtggagttccgcaacctggaaaacttcaagcaaggccgctggagtaacatgtacaagctaccctacaactggatcggcacaggccacgtggtgtaccagggcgccttctactacaaccgcgccttcaccaagaacatcatcaagtacgacctacggcagcgcttcgtggcctcctgggcgctgctgcccgacgtggtatatgaggacaccacaccttggaagtggcgcggacactcggacattgactttgccgtggacgagagcggcctgtgggtcatctaccccgccgtggacgaccgcgatgaggcccagcccgaggtgatcgtcctgagtcgcttggaccccggcgatctctccgtgcaccgggagaccacgtggaagacacggctgcggcggaactcctacgggaactgcttcctggtgtgcggcatcctgtatgccgtggacacgtacaaccagcaggaaggccaggtcgcctacgctttcgacacgcacacgggcaccgacgcacgcccccagctgccgttcctcaacgagcacgcctacaccacccagatcgactacaaccccaaggagcgggtgctgtacgcctgggacaatggccaccagctcacctacaccctccacttcgtggtctgagtggagacctgtgctccccggagaggggcagcagtgcgggaggggctttgcacagcagctcctgcaactgacccagtccgcaaatatttattgggggccagcccagggctgggactgggcatgaggtggtcaccaggattgagcttcctcagcacccagtgggtaatacttgcttccacttgcagagcaccgtgccaagcacttcccacacacttacccgtttgattctcctagcacctcccttggaggtagagatcatgaacccatttaacagacgaggagacaggctcagagaggcaccgtcccttgcctaacacctcagttgtgatcaggcaggctgtgctctcaggacagccccattttagggatgaggagacttcaccacgccctcccctccctgccctcccccatctccccggtctcccttgttctctcaacccagtctcccttcccagggccactcagaaccagaggtctttagggccagtgtactggtgtggggtggaggccctggctctgcctgccatcctagggccctgttctggctgagctgttggtggccctgggctttgggccccttagccaatgtccttgtctcttgtctttggccagccccctcagcccagcccaccccacccgctgtccggccacattccaaacctctaccgtcacctagctgctgagcagaaaccgcaccccgagagaaaatcccatcctctgttccaaggcccctgtctgctctatgctcatttttattttctcttattcttcatcagtgccgtcatttgtttctgcagcagcagctgagaaggcagccggcagctctgccagggtggggagctgagctgaggctccctctccacccagaagcactggcgttgttcacatagtcaggccttgggtcccctccctggttcatcccagagcctttgggcctggagtccgccttgtcctttttctctgggctttcaaacccacaacctttacacactcagggatacctccgggtctgccatgaataagaccctaggcccaagtctggtgtggtgccaggatggcacagtttccctcttccttgccagccctgacctggtcactgggcaggctggcccagcagcctgggggctgcagaagacatggtgtgagtagttgggtccaggggaggcatcaggccttcttctggttgcaggagagaaccagagggtgggaacggggagggaagaactgagggtctgcagactggacttttcctggctcgacccaggacttgggttgaggatgcacgggggccaccttgcccggggccactggtggctccccagagcctcagacccacacagcccagaggacgaggccttcaagcctgcccctcttctgcttttttagacagtatttttagagctggaaagaaattttctagcccaactccctgtttcatgaaagagaaaagaggctcagaaaagtttagagagcagctcagtgtcacactgggagctgggcacagccgatctccttccagaagggttctgtctgtatcctttattctccgcacatggaggctgccctacctgggaaggcaccccagcacctgtgaaggacatttactgctcatcctcacctgccccctggcccttgctgccttcattctgtcccaatgccagctccctggatgtctgtatgtttgaataccagttgccatgttaggaaggtcagctgcacagccaagagtgtaagagtgtaaagaaatgcctttttttttttttttgagttggagttttgctcttgtcgcccaggctggagtgcagtggcgcgatctcggctcactgcaacctctgccccctgggttcaagcgattctcctgcctcagcctccctagtagctgggactacagcacccaccaccacacccagctaatttttgtatttttagtagagacaggggtttcaccacgttggccaggctggtctcgaactcctgaccttaggtgatccgcccgcctcagcctcccaaagtgttgggattacaggcatgagccactgcgcctggccagcaaatgctttttgtgcagaatacacttctttcaggcattgtcaggtgctgttttgtttaagctctaactcacccctggaatacaggggaatgatgacaaccagcccagccaggcctgactcatcatggtcacatccagcccccacccccggccaactaaccactgcaggctcctcttccagactcaccagggggcctcgaggccccggcatctcccttggccctgggtgtgggttttacaagactgtgtctttcatgacatcatagcccaaccatgtgagaagaaggagaaggcccccctttcttcattaatctgaaaaaaaggaaagtgagaataggctgatttttaaaagttaaggggcaagcagcattgcattctgggggaacgatcctggccacagccgccaaacaaacattcactaggcctcttctgttttcatacccttgtaagtgggttatgtggtgggtatggtcagttttttcttttttcttttcttttcttttttttgagacagagtttcgcttttgttgcccgggctggaatgcaatggcgcgattcagctcactgcaatctccgcctcccgggttcaagtgattctcctgccttagcctcctgaaaagctgggattacagggccctgccaccaagcccagctaattgtatttttagtagagacaggatttcaccatgttggccaggccagtctcaaactcctgacctcaggtgatccacctgcctcagcctcccagactgttgggattacaggcatgagccaccacgcctggccagtttcttcattttacatatggtcacattggcgcctagaacagttaggtcgctcgtcacataggcagttaagtggagaaccaggtttcaaaatcaggtaagaaaaccatcatcattaactgagcaccagctgtgctaagcctgccacgggcgtatccttgcagcctcacaacagtgggaggtctgtatcctgaatgtcctcattttacagatgaggacattgaggagaagagacttacccaggctcacacagcagctcagcctgttccaggcgctggtcagtgcgtgttctttgccaccagcctgtcactccagtggcagctccagaaacggaggctgttgcttttatccctaaactgcatccacagagaagccccaagaaggaggttggggccagctcataaaaagcctgaatgccaagccaaggagtggatgcctccagtcatatttagaacaaagtcaagtataaatttacagagaaaaaattctaagacagttggatgttgtcctgttggtgaggaagggaaaggtttttcttgtagggaactggaaccagcccacaactgcacgcttgtgagctgtcatggaaacctgatccccaacagcttttgaggttgtttgtttgtttgtttgtttacctgtcttgggctttgttgcttttggcaaaaggtacttcaaacaagggagggcctggactgagggggaccaggtcttcttgctgacctcgtctacaaaggcaaaggaaggcaaaggaagctgtctcgggtgtttctgaacaacgtgactcatgaggggctttggctacctcttgcgttccccctagagatgtccaggccttacatttaatcggctttctctgcggtggggtagagaatggagctcccgccttgcgggcagtgctaaaggtggagctgggggattttcctgggaatgatttgagggctcttgaaagcccatgtgttccaaagcgtctttaactctgggatagcattggaagccgctgtcatgacaggacatggcactggatggctggcagagagccctggctgggagttagggagccctgggttggaatccagccccacctcttttatgccacaggtttggtcaagttctctcccgctcagggtagggctgtgaactccctcttacagctaagaacatgcagcttagtgaggacaagacccttctagagctttacccctaatccccccccaggagccccgaggccggcattattcctccccattacaggtgatgagcctcaaattcagagagcttaagcaacctgctcagggtcacgtctccaacaggcagtagagtcaaggtataaaccaggtctgtttttgtaccagagtcccagactaactgttggtaggaatcttgtaaccagtcatgttttcttccttgttttggccgctgggaagctcaaagtcaaattcgagacccttttttttccaattgtgctgagtctcctactagactcgcttcattctagctttctgcttttacctttaccctaatctttttatttttatgctattgtactttatttttgtaagttgctgagatatctgttttgcaacaagatgggctatatctaaataaagacatgatcaaaggtttgatttaaaaaaaaaaaaaaaaaa

SEQ ID NO: 166 - DNA, 7998 bp, Homo sapiens
aggagtctgtcagctacggaggacaatgaccttgcagacaccaccgcctgagtgagaaccaggggtctgtgcctctcctcattccccgctcttgcccttgtcaagcctgcaccagcatgtcaggaacctccaaggagagtctggggcatggggggctgccagggttgggcaagacctgcttaacaaccatggacacaaagctgaacatgctgaacgagaaggtggaccagctcctgcacttccaagaagatgtcacagagaagttgcagagcatgtgccgagacatgggccacctggagcggggcctgcacaggctggaggcctcccgggcaccgggcccgggcggggctgatggggttccccacattgacacccaggctgggtggcccgaggtcctggagctggtgagggccatgcagcaggatgcggcccagcacggtgccaggctggaggccctcttcaggatggtggctgcggtggacagggccatcgctttggtgggggccacgttccagaaatcaaaggtggcggatttcctcatgcaggggcgtgtgccctggaggagaggcagcccaggtgacagccctgaggagaataaagagcgagtggaagaagagggaggaaaaccaaagcatgtgctgagcaccagtggggtgcagtctgatgccagggagcctggggaagagagccagaaggcggacgtgctggaggggacagcggagaggctgccccccatcagagcgtcagggctgggagctgaccccgcccaggcagtggtctcaccgggccagggagatggtgttcctggcccagcccaggcattccctggccacctgcccctgcccacaaaggtggaagccaaggctcctgagacacccagcgagaacctcaggactggcctggaattggctccagcacccggcagggtcaatgtggtctccccgagcctggaggttgcaccaggtgcaggacaaggagcatcgtccagcaggcctgaccctgagcccttagaggaaggcacgaggctgactccagggcctggccctcagtgcccagggcctccagggctgccagcccaggccagggcaacccacagtggtggagaaacacctccaaggatctccatccacatacaagagatggatactcctggggagatgctgatgacaggcaggggcagccttggacccaccctcaccacagaggctccagcagctgcccagccaggcaagcagggcccacctgggaccgggcgctgcctccaagcccctgggactgagcccggagaacagacccctgaaggagccagagagctctccccgctgcaggagagcagcagccccgggggagtgaaggcagaggaggagcaaagggctggggccgagcctggcacgagaccaagcttggccaggagtgacgacaatgaccacgaggttggggccctgggcctgcagcagggcaaaagcccaggggcgggaaaccctgagcctgagcaggactgtgcagccagggctccggtgagagctgaagcagtaaggaggatgcccccaggcgccgaggctggcagcgtggttctggatgacagtccggccccaccagctccttttgaacaccgggtagtgagcgtcaaggagacctccatctctgcgggttacgaggtgtgccagcacgaagtcttgggagggggtcggtttggccaggtccacaggtgcacagagaagtccacaggcctcccactggctgccaagatcatcaaagtgaagagcgccaaggaccgggaggacgtgaagaacgagatcaacatcatgaaccagctcagccacgtgaacctgatccagctctatgacgccttcgagagcaagcacagctgcacccttgtcatggagtacgtggacgggggtgagctcttcgaccggatcacagatgagaagtaccacctgactgagctggatgtggtcctgttcaccaggcagatctgtgagggtgtgcattacctgcaccagcactacatcctgcacctggacctcaagccggagaacatattgtgcgtcaatcagacaggacatcaaattaagatcattgactttgggctggccagaaggtacaagcctcgagagaagctgaaggtgaacttcggcactcctgagttcctggccccagaagtcgtcaattatgagtttgtctcattccccacagacatgtggagtgtgggagtcatcacctacatgctactcagtggcttgtccccatttctaggggaaacagatgcagagaccatgaatttcattgtaaactgtagctgggattttgatgctgacacctttgaagggctctcggaggaggccaaggactttgtttcccggttgctggtcaaagagaagagctgcagaatgagtgccacacagtgcctgaaacacgagtggctgaataatttgcctgccaaagcttcaagatccaaaactcgtctcaaatcccaactactgctgcagaaatacatagctcaaagaaaatggaagaaacatttctatgtggtgactgctgccaacaggttaaggaaatttccaacttctccctaatcttcaactctgctgctccaatgggtccagaaattactgaggccagtggtgaagtgaagagatgactcaaacatttaaataatttggctttttggtattattgattccacttattttgtaaaaatggttatggctgctgccttccttgtggatgaaaagtggctgtaaagaagcttcctaagaacgtttttttctgccttgtaagatcactacgtgtgaaatgctctgagtacctttcaaatatacctacttttggtggtaagtgtagggatgctttaggtaggtactttgcatctgtcgaatttaaattctaaactcacactgattaaggaactcagtagactactttgcaggggccatgttattcagtgttatctcctccagtacaaagaattcctagaattttgatttgctcaggtgtgagctgacattttattgtactaccccattcttgtgttaagccatgtggatttaggacagtgatcttcaaacttgctttaacttatgctcccttttgagaatcagcatcacttgaaatgtcaaaatatgtcaactctcatagccaaatcaaagaagtgatcattttgactgtgctttttaaatctccacacacctccacctctctcctaattctgcctgtcttaacccctctgtcttagttataaatttctggtcttgtaagtctggaagctgataggcaatttatgaaagagataagaatgtaatgaggttccgctttctgagaaacacagaaatgatacatcctgagacataaaggaaagctgctcttctgctgcctcaggctgtagcactctcaatgttgtcactctacacatacactttctatatacatgtacagttgacccttgaacagggtttgaattgcagtcaacttaaatgtggattttctttcacctttgtcacccctgagacagcaacaccatgctctcctcttcatcccactctgcagcctactcaacaggaagatgatgaagatgaacacctttatgatgatccactttcacttaatgaatagtaaacatatgttttcctccttatgattttagtaacttttctctagcttactttattgtaagaatacagtatataagctgggtgtggtggctcatgcccataatcccagcactttgggaggctgaggcaggcagatcacttgaggtcaggagttcaagaccagcctggccaacacagtgaaaccccatctctactaaaaatacaaaaattagtggggcgtggtggcggatgcctgtaatgtcagctactctggaggctgaggcaggagaactgcttgaacctgggaggtggagtttgcagtgagccaagattgcaccactgcactccagcctaggcaacagagcaagactccgtctcaaaaaaaaaaaaaaaaaagaatacagtatatgtatatatacacacacacaaacacacacacacacgaacacatatgtgtgtatgggtattaactgactgtttatattattgatagggcttccagtcaacattaggctattagtagttaagtttttggggagacaaaagttatactcagattttctactgcaagggggtaggcactcctaaccctcacattgttcaagggtccactgtacatttaaacacttttctatatgcattagagtagccctgtcatcccttcactgaaatcatactgttctcaacatggcaagcaactaacacttttttttttttttgagacagggtctcactctgttgcccaggctgcagtgcagtggtgtgatcttggctcactgtagcctccgcctcctgggctcaggcgatcatgagtacctgggaccataggtgcccgctactacacccagctaatttttgtatttttagtggagatagggttttgccatgttgcccaacctggtcttgagctcaagcgatccacctgccccagcctcccaaagtgctgggattataggtgtgagccaccacacccagcttcaactaacacatttacgaacttgtatacatgtatatttagatactttaccaacttgtaaaatggttaaaggagtactttattatgaaaaaatatacaatctttaaaatttccttacttctacatgatttttgtgctattcccatttttttcctcaggtgagcagctttagttttttattttttttgagagagtcttcctctgtcacccaggctggagtgcactggtgtgttcttggctcactgcaacctctgcctcccgggttcaagtgatcttgtgcctcagcctcccaggtagctgggattacaggcgtgtgctgccacgcccagctaatttttgtatttttggtagagatggggttttgccatgttggccaggctggtctcgaactcctgacctcagatgatccacctgtcttggcctcccaaagagctgggaatataggcatgagccactgtgcttggcctcaggtgagcagctttagtcaatgttgtgaattttagattttaattagacatgcaacagtttcactacctttcaggatttttgtcctgtaacagaggctcttgctttttgacagagaggtaggcaggtggagaggttatcctgctgctgcagttctcaagttgttaagtttcctctggaaggctaacccttgttgggaactaacagtttcaataccagcaagtctaggcctgctccaagttggtcagctgaagaatgaacatcagaagacacagctgctgaaagttgtcctttgatgagacagtgatagtgatttggtaaaatgtcttattttttaaatgtcagttatctttctttaaaaggttttttgagggcagcctccagaaggagctagagagtatattttatagttctattgtggttcataccctgttttcgacttaagattctggagaatgctatgaaacatctccccagaaaaagacagttaattaccatatctagagcagcactgcccaacaaaaatatagtacaggctatacacataattaaaacatttctagtagcttctctaacaaaacccattgaaagccaattttaataatttatataacttagtgtatcaaaaatatttcaatatgtaatcaacataaaattgagatactttaccagctactagggaggctgaggccagagaatcacttgaacccagggggtggaggttgcagtgagccaagatcacaccattgaactccagcctgggcaacaagagcaaaactccgtctcaaaaaaaaagagatattttatattctttttctcatactaagtctcaaaaatctggtatattttacacttaaaaacacatgtcaaggctaggcatggtggctcacatctgtaatcccagcactttgggaggccaaggtgggcagattgctggccaacatggtaaaaccccatctctaaaaatataaaaattagctgggcgtggtggcgcatacctgtaatcccagctacttgggaggctaaggcacaagaatcacttaaacaggaggcaggggttgcagtgagctgagatcacaccactgcactccagcctgggtggcagagcaaaactttgtccccacccctgacaaaaaacaaacaaacaaacaaaacaaaaaaaaacctgtcaattcagatgctaggttttcatcagacgtacttaatctgtatttagatttcttaaaacttactgtggaaaatgtatttacatactcaagttgtttgaaacataactcactgttttccaataactgaagtatccacttttacatgtattaaaattaaataaaattagaaattcagttctgcagttgcactagccacattttaagtgtttaatagccacacgtggttagtggcatctatattggacagggcagatctagagagaatcctgtatctaacaattttaatttttttccctttatgctgttattccttacctagagaaacaatttccctccaaagttcctttgaggggtctgtttaggccaggccaacacaagtgacctatgtggattttagcatcctttttttgaaatttgaggttttatgaagcttgagtttttctggatatttttagtaatttgctggtgtgtacttagctcaaatacttgattgcaactgtgttgggtcaactatttctaatgggacttttccatttgcatgtacagtcactggaaactgctgggcagagaaactctaaaaggtagttggggcacactttttccacctgtcagattggtgaagaattggtgaggctgtggggaaaatggcattctcccacttttgatggatatgtatccaaataaaagtcattcccatgctttctttcatccagaaattttatttctagaaatttatccctccgtacttgaacaattgtatagagatttattcaaaatgatgtttactatagcactgttgctaatggcccagtaaaaacaaccaacacatgcctattagtttggttttagttaaatgaattttgccacatccatgtagtggaatacctcacagctgttatagatagatctagatatactgaaagccattttttcttaaattatagaatgtatatatggtatcatcccatttgtgaagagacatatgcttatatgtgcattaaaaaaccgtaggatatgcaagaaacttaacagtggagtgtgaaaagtgggtgattgggagagggggaattccacttttcatttatctttctgaaccttttgaatcttttttttttttttttttacaatgagcatgtattcctttttttttttttctttccaagatggagtctcactctgttgccaggctggagtgcagtggcgcaatcttggcttactgcaacatccacctcccgagttcaagtgatttctcctgcctcagcctcccaagtagctgggactacaggcatgcgccaccacgcccagctaatttttgtgtttttagtagagatgggctttcaccatgctggccaggatggtctcgatctcttgacctcgtgatctgcccacctcggcctcccaaagtgctgggattacaggtgtgagccactgcgcctggcccgcatgtattacatttataattaaaaattcacaactcaatgtcaagtgtgaaccttgtgttgaccctgatttgagcaagcaataaaaagatatttttgagacatttagattatgaatttcacatttgatgatagttactattaattttgtgaggtgtgatattggcaatgtggttagatgacttcagagaaaaaggaaggtatagttaagcaagtatggcaacatctaataacttgggtctaggtgatgtgtatgggtttcattatactgtcctctttactgttgtatgtatttgaaaacattcatgacaaaaaaactttttaatcagttaaataaaccatgaagaacggttaaagaa

SEQ ID NO: 167 - DNA, 1399 bp, Homo sapiens
cgcaggatgagcgatcggggcccgggcagccggcagcggacgcgccccccgagcccaccggcccgcgccccgcgccccccacggccccgcggtcccggtcccggccgcatcacccacgtcccccgagccccacgggccatgcccggccggccctaagcgcgggccggggggcgtccccttgcgcccgggccccgcgctggcgccccccgggccgccgcccggcgcgggggccatggcgttcaccttcgccgcgttctgctacatgctcaccctggtgctgtgcgcctccctcatcttctttgtcatctggcacatcatagcctttgatgagctgcggaccgacttcaagaaccccatcgaccaggggaaccctgcgcgggcacgcgagcgtttaaaaaacatcgaacgcatctgctgcctcctgaggaagctggtggtcccagaatactccatccacggcctcttctgtctgatgtttctgtgtgcagcagagtgggtgaccctgggcctcaacatccccctcctcttctaccacctctggaggtacttccaccgtcctgcagatggctctgaggtcatgtatgatgcggtctccatcatgaatgctgacattctcaactactgccagaaggagtcctggtgcaaacttgccttctacctgctctccttcttctattacctgtacagtatggtttatacgttggtgagtttctaagggggaagccggccagggagcgagcccagaacggaccggacgcctgtgcacccccagccctgccccttggccgcagaggcctcagccctggggagggagggggcactggtgcccccagcctctccaacccccaaactgctgctgcggggaaccccccccaccccgccttcagagccctcccccttggactagagcggctgggcagagctctaaacaggggcaggggctcctctgccagcctgtgggcatggcagtcattcctggaaggggcaggacctccggccttgtccatttcgggggaaacttgggccctgccaaggggcagagcttgaccctggaaattctgggccatccccctccacccccaccctgaggctccccctgcaggtgggggggtacccgcaccgggaatgagcaggctcagcaggggggcagccccacccctagtctgccctcccctctcccccaggctctttctccagccctgtctccatctgccccaacctcagcccaccttgtctcttggacctattttctatgtcgcctggaggagtccggcaccccctccccggccatttgtgacaaaatatgaataaactactgcaaatatgtgggaaaaaaaaaaaaaaaaaaaaaaaaaaaaaaaaaaaaaaaaaaaaaaaaaaaaaaaaaaaaaaaaaaaaa

SEQ ID NO: 168 - DNA, 828 bp, Homo sapiens
gtaataaccgcgcgcggcgctcggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtccatggggtatacaaaaagagtatctttgttttcactcatgtacttgtacctgtctggattattcattattacatgaagtatcatgtttctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcatatctgttttcaagcattgtacaatttgagactgagtaatttaacaataagtaaaaagtggacatgctaaacaaatatgagagactacctactttttctggtcattcttgacttggaaaacggtatggaaaagtatttagttacatgtttgtttgtttttttcttacacagtacttacactaatttggtatcagggtatgcaacagtgaaatatcacaataaacaaatgtaagaacaaaaaaaaaaaaa

SEQ ID NO: 169 - DNA, 4753 bp, Homo sapiens
agtttgacgtcgtcagccggcttggtcttctacccagtgactcaaagcactaaaagtcagcataatcggaactgaagtcagtagcatcgcccatttgccattcactgcagtagcaaaagtagtactctgtggtgggttaatcggtttgaggcagctccttaaatgaacatttgtgtttcatttttctgttattttcccgaacatgaaaagacgataaaactgaaatggaaaagatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtattatcagaaaatgtgaagaagaaaaaaatgccatgttttaaaaccactgcgaaaatttccccaaagcataggtggctttgtgtgtgtgcgatttgggggcttgagtctgggtggtgttttgttgttggtttttgttgctttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcattgagtgtgtccagtagtgcaggaaatgatgtcttatctaatgatttgcttctctagaggagaaaccgagtaaatgtgctccagcaagatagactttgtgttattctatcttttattctgctaagcccaaagattacatgttggtgttcaaagtgtagcaaaaaatgatgtatatttataaatctatttataccactatatcatatgtatatatatttataaccacttaaattgtgagccaagccatgtaaaagatctactttttctaagggcaaaaaaaaaaaaaaaaaaaaaagaacactcctttctgagactttgcttaatacttggtgacctcacaatcacgtcggtatgattgggcacccttgcctactgtaagagaccctaaaaccttggtgcagtggtggggaccacaaaacaaccagggaggaagagatacatcattttttagtattaaggaccatctaagacagctctattttttttttgccactttatgattatgtggtcacacccaagtcacagaaataaaaaactgactttaccgctgcaatttttctgttttcctccttactaaatactgatacattactccaatctattttataattatatttgacattttgttcacatcaactaatgttcacctgtagaagagaacaaatttcgaataatccagggaaacccaagagccttactggtcttctgtaacttccaagactgacagctttttatgtatcagtgtttgataaacacagtccttaactgaaggtaaaccaaagcatcacgttgacattagaccaaatacttttgattcccaactactcgtttgttctttttctccttttgtgctttcccatagtgagaatttttataaagacttcttgcttctctcaccatccatccttctcttttctgcctcttacatgtgaatgttgagcccacaatcaacagtggttttattttttcctctactcaaagttaaaactgaccaaagttactggctttttactttgctagaacaacaaactatcttatgtttacatactggtttacaatgttatttatgtgcaaattgtcaaaatgtaaattaaatataaatgttcatgctttaccaaaat

SEQ ID NO: 170 - DNA, 2147 bp, Homo sapiens
gaaggaggaagcgcgcggggcgccataaggaggaagcgggtagtcgaccgtgtccgcgcgcctgggagacgctgcctcggcccggacgcgcccgcgcccccgcggctggagggtggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacaaaaaaaaaaaaaaaa

SEQ ID NO: 171 - DNA, 4540 bp, Homo sapiens
gaatgcattagtctaatgagatgtttgcagctggagcgcagggctgctggagactaactgtgagctactaacacgggtggaagatagcttttgcaatactcggtttgcatgtgctgaaagtcatctgtcttctgagtcaacactcccgacctggtaaacaacctgctcagggctctggtgaacaagctgtagcacctcttctgcctgtgagcgatttgtcacctcattctgtaagactggcaccagcagaaatgcagtctcaaaggatcccggggagaaagcgaggccgaccctcacttcactccacgcctatgaagatggcagttcataacctttattctgcttcagctggctctttaccagcagtgaagatcccaaagaaaagagggcggaaacccgggtacaagatcaagtctcgggttctcatgactcccttagccctctcacctccgcggagtaccccagagcccgacctcagctccatccctcaggacgcagccacggtccccagcttggcggccccacaggctctcacagtctgcctctacatcaacaagcaggccaatgcggggccctatctggagaggaagaaggtgcagcagctcccggagcattttgggcccgagcggccatcggcggtgctgcagcaggccgtccaagcctgcatcgactgcgcccaccagcagaagctggtcttctccctggtcaagcagggctatggtggtgagatggtgtcagtctcggcttcctttgatggcaaacagcacctgcggagcctgcctgtggtgaacagcatcggctatgtcctccgcttcctcgccaagctgtgccgaagcctcctgtgcgatgacctcttcagccaccagcccttccccaggggctgcagtgcctctgagaaagtccaggagaaagaggaagggaggatggaatcagtcaagacagtcaccaccgaagagtacctggtgaaccctgtgggcatgaaccgctacagcgtggacacctccgcctccacctttaaccacaggggctccttgcacccctcctcctcgctgtactgcaagaggcagaactctggagacagccaccttgggggtggtcctgctgccaccgctggtggtccccgcactagccccatgtcttctggtggcccctcggcacctgggctgaggcctccagcctccagccccaagagaaacacgacctctcttgaaggaaacagatgtgcctcaagcccttctcaggatgcgcaggatgccaggcggccacggagcaggaacccctccgcctggactgtggaggacgtggtgtggtttgtgaaggacgccgacccacaggctctggggcctcacgtggagctcttcagaaagcacgagattgatggcaacgctctgctgttgctgaagagtgacatggtcatgaagtacctgggcctgaagctgggacctgcactgaaactctgctaccacattgacaaactgaagcaagccaagttctgacttttttaaaaagacagaagcgaaacccaaaacaacagatcccaagattatcttctgccttaccaatatcccgccaacatcacaaactagactctcctcttaaaattaacagccacagagacgtggtctttttataaaacttgtgaatctttgccttttgaagaatttaacatggaccttttcgagaggctcctctgtgttcataatttgccaaaaaattacaaaagcctgtgatttttaacatccctgttatgctggtttctcttaaagtgggtcctatttgcataacgagagagtggggaactgaatgcttatgcccaaggagagttctggagggttcaaaggatgaaagaaggacctttgtccctgcggtctctgcagggacaaccccctcagcaccatctgcctctaactctgacctggggacctatccatgtgagccttgtttgcctcagctctggaagctgacttctgaagatgactgcctcaccttgcactgtctggaaaacttgaattattttacgccgtgaaagaaaaaggaaaaaaaaaaaaatcttttctgttcctagaaaatctgaagtactgtgtttctccgctagagggcagactgctaatgaaatttcaggaccctcactgactgcagtagcaggattgttcagtactgagtggatgggttagggtgtctgtgaacaagatctagcccacacagaaacaggggatttattccacagttagcaccacagattgcgacttgggaagaaaccatcagctagaggggtctagttcgtatccaatcattattgactgactgactgatactcaactagcaaaggcaagaatttggaagcacgctctacccagatgggactttggagttccttcccttccagagtccttattgaggtgttgaagtgttggcatgccgaagaatcttagtgacatttagccatgggtgtttctttaaaaaaggaaaagaaaatgtctcaacgaagctttgaaatgggagagtgttgatttctagttacattgctgggttatgtagttgtatctgtggctaatttttctagtcctcaacaaatacacagacatgctattatggggtttaattcaatttacaaataggttttccttcctcacagtggagtaatagaaaaaattgattttctgctcctttgcagctgtgtccagagacggacaatgaatccacaatttattaggcagaggcacaacttctccaccattcgttttatccttctcttttctctgtttccctccacctctcttcttcttctttcacactgagcagaaaacatatcttcaaaatgaattcgcctttgccatgtgcatattctcttccttaaaaggacatcaacagtgttggagatgaggagatgaacattagattttggaatttctgggagggagagggttagggatgactcagggcctcccttcgcccaaaggtgaatcagaaaaggcacccctttctctgggatacaacctgagcaggggtctcagctggcaagtggagcagggtgggggctcaacctcctcaccgcttgatcagctgccgttgtacagagcatgacctgtataaccttgagggcagccctgggtagatctgcagagtgaccctctatatagttagaatccagatgaaggccataagaaatagtccatgccatgccgttaggcccactttcatgtgcagtacttgagaaagcacatcgtagcctccttttcagacacacaaatggcggctggactgagagcatggcagagaaggggaggaggagaatgtactaaacttgctcactgaattgagcttgagttattagattgtagaagagcttgatgtctggtgattttgttacaggaagggggtcccgatccagaccccaagagagggctcttggatctcatgcaagaaagaattcagggtgagtccataaagtaaagtgaaagcaagtttattaagaaagtaaaggaaggaaagaatggctaccccatagtcaaagcagctctgagggctgctggttgcccatttttatgtttatttcttgatatgctaaacaaggggtggattattcatgcctcccccttttagatcatatagggtaacttcctgatgttgccatggcatttgtaaaccgtcatggcactggtggtagtatagcagcgaggacaaccagaggtcactctcgttgccatcttggttttggtgggttttagccaacttctttactgcaacctgttttatcagaaggtctttatgacctatatcttgtgctgacctcctgtctcatcctgtgactcagaatgctttagccatctgggaatgcagcccagtaggtctcagcctcattttacccagctcccattcaagatggagttgctctggttcaaatgcctctgacaggttcagcacctgagaaaagtaccttgaatcaggccttggggcagagtcttcaagattttaaggtgatagggcctgtctcttaagaatttattaatcgtaagtgctcactgctggtttagagttagatacatttccctcaaaacagccatgggcaggttatgtactcagaactgccagggtgaaaacaatgagatccagaaaaatcccacaacaatccaggtttttcactcctcttttttttctcaatcttccgatacttgtggtacctcttccatcaacagatacctcatgtagtgacttccagtatcaagttttcaaaacttcctacccaccctcatcagtgcctccttcactacagagtcacaaacattggtgctctcaaataaaaatcagccccaaacaatgtcaaagagatcccttgagtagttttcaggcgagagatatgttctcatttcaagtcttggagaaaactggatccatgttcacgtggaacttctctcgcggaggtgctatctcattttgcattaaactttaagcaggacagattgctgaagccatgatatttaaggtttgactttttaaaaatctcattactcttaaaataaatgctgccacatcagaaaaa

SEQ ID NO: 172 - DNA, 2408 bp, Homo sapiens
aactcaaggcataaggcgatccagcacctaagatctcagcaaaaaaaagctaggtcctgaggcagctagtggaaaaacaagagaagggaagtcaaaaggctacttgctgtcagctaaagccagacaacctctcctgtttcatctcctggcaacagaatgcatcctccttttgggaaactgcctctttccccactcctcagagtaaatcttgctgctgctcactctttgggtctgcactgcccataagagctgtagcactcaccgcgaaggtctgcagcttcactcttgaaaccagagagaccacgaacctaccgggagaaatgaacaaattccggacgcaccatctttaagaactgtaacactcactgcgaggatctgcggcttcattctttaagtctgtgagaccaagaacccaccaattccggcacactaatatgctgttggaaactggctatatggaaaggctatgtggaagaaaacaaacaccccagccaacataatggagctcccagctgacagctgacatctagctgattgccaaccactttggaaactgatcttcaaaacccacttgagctatgtcaagagaagccacctgtgacacagaagcagaaggatccaagtcaaaggagtttatttgggaggaaatagcacgagagaatgatcattcgtaactgaggcacacttgccttttgcaactaagctctactgaattccaaagctatagaaatatccatcttgacctggaaagtctgtttctttgctagtccagaaggttttttttaacatgaacaagatcctctcaagcactgtttgctttggactcctaactttgttatccgtgttgagttttttacaatctgtgcatggacgaccatatcttacccaaggaaatgaaatatttccagataaaaaatatacaaatcgtgaggaactattgctggctctactgaataaaaattttgatttccaaagacctttcaacactgacctagccttacctaacaaactggaagaacttaaccagctggaaaagctaaaagaacagctagtggaggagaaggattctgagacgtcctatgctgtagatggtctattctcttctcatcctagcaaacgagcttgcttttggaaatactgtgtttaaagctttttctctggatgcaaaaaaagataagaatatcaggaaaatatatgtatctactcactctgctgtaggcagaccccctgaaactattgctgtggaataaaagatgaaatgctcctgattattgtaaatacaaaattgcatgcgggattgtgtaaagacaatgccaggttggactgccagaatgagccaacagcacttgcttccccctgtagagagcctatgaatggacgtgcagtcagggaggtttcatatcaccaagattcctatcccagaaaagcagatgttcatagctctgggaatggaatgcgcccctcgtggagagcctataaacggatgcatggaaggcgcctgtccatatggataagatagggttgtaaacgtcctcatcttgccatggctcttctaggcctctttagggttaaggcatatttccttctgagaatttctggtctaagcggttgtctagcttcatgtcctgtttccatggattgtttgtaaccagcttttgttacaattgttactgctgattaatatcttgctaatcataggttatggaaagattgtgtttctgttttaaggctctgttagaaattacacacacagtatattgtaaattcttatctctgtatactgtacttctacatacaaatgtactgtacttctacatacaaatgttatgttaaagaattacttcatccccatgtgaccatctcacctcataatcaaatgaccctaaatccctcattaacctacccctgcccttgctaaacttaataataaatgctggtatatccagtgcattgttggcaccatgggaccagaaggtggtgacccccctggacccagctttcactatcttgtgtgtgtctgttatttctcaacctgctgatccgcctgggaacaaagagccccgttgcattgcgggctactggccagatcccgcaatactctgctatttaaaattgtagctgtttcaatcataaagaaactggcatttattatgcatatgattttttcaccttgttcttgttactaagtcaattatgataagcttaaggtttatgttgtgaataatcactaatcagttgcacttttgaaggtatgtcactatcaaaatggttttgtagagctagagttgaaaatgctgtatctattgtatgctttccataaattcattgcttatgtaaagttttgtcctgttgtgactatgctgttgaactattaattaaaacattttgaaaagcatcttggaaagtta

SEQ ID NO: 173 - DNA, 1925 bp, Homo sapiens
actggcaaatgtgagggctccttgtatcgcagtccaaccccagctcatttcttagtataggtttgtttttaggatggtcgagctcaaagcagaactaagggatctgccgttttgtacacggccgaggcgcgcggctccctgggcctggaacgcgctctgagcgcgccggtcccttccaggttgcgcgggctccggacgagacccagcccagccgggcagccccgcgcgctcccgggtcccgccggcctcgcgccgcccggttgccgtgggaaccacggagcctcggagcgcccgcagactagcccgtgtctgagggggtgagggatactgaggcccaggcatggagctgccggatccggtgcgccagcggctgggaaacttcagccgggccgtgttcagtgattccaatcggaccggtccagagtccaatgagggtccggaaaatgaaatggtctccagtttggcactgcagatgtcactttattttaatacctactatttcccactgtggtgggtgagcagcattatgatgcttcacatgaagtattcaatcttacctgactactacaaattcattgtgatcactgttatcatcctaataaccttaattgaagccatccggttgtatctgggctacgtgggtaacctacaggagaaggttcctgagttggctggcttttggcttttgagccttctattgcagttacctttaattcttttcttgctctttaatgaaggcctaacaaatctgcccttggaaaaagcgatacatatcatcttcactctcttccttgctttccaagttgttgcagcatttcttaccttaaggaaaatggttaatcagttggcagttcgtttccacctccaagactttgaccggctctctgcaaacagaggagacatgagaaggatgaggtcatgtatagaagagatctgatccagtgttgttgagtgaaaatctgacagatcattctagagactgtaagagttaggaaaatatcagagctctgagaaaagggacaaagcaagtgttttgaattgtatatgctctcactctgaaattccaaggttgggggcaatgatgaaactttgtacagtatatgaaacagtatattaaccctaaaacctagatgttgtccacctgatgccaaatttcttaattttttttgatgttgttgtctttttcaggagtgtagaaatctatgtattggtggttgtcatttgccagctctctcgtagcatttctggttagaatctttaactagagatgtatacatttctttaaaacttgttggttatccatgtcttgtctgtacatatgaccatgtttcttgacatggaaataccagtcagtgttcctatgtatttgtctatatttgtaaaccaagagaccggctgggtgtggtggctcacgcctgtaatcccagcactttgggaggccgaggtgggcagatcatgaggtcagaagatcgagaccatcctggctaacacggtgaaacccagcctctactaaaaatacaaaaaaaaaaaaaattagctaggcgtggttgcaggcacctgtagtcccagctacttgggaggctgaggcaggagaatggtgtgaacccaggaggcagagcttgcagtgagccgagatcaagccactgtactccatcctgggtgacagagcaagactccatctcaaaaaaataaataaataaaaaataaaacaagagaccaaattttcatgtctgctagggttaaattctaaccctaatattagctgttatactgagatgaagaagaaaacaggtggattgccttggtatttaggaaatatttttgttataaaattacaactttcataaaaccatattcagtatttgtaatggtggtatacaaaatgcttttacaataaattattaaatatttaaggtatcagcagc

SEQ ID NO: 174 - DNA, 1202 bp, Homo sapiens
gccgccggatggcgtaggatcggccgctggtggtggtgataccgggtacccgggctatggcgccggcgcagcgctgccctctgtgccgccagaccttcttctgtggtcgcgggcacgtttacagccgcaagcaccagcggcagctgaaggaggctttggagaggctcctgccccaggtggaggcggcccgcaaggccatccgcgccgctcaggtggagcgctatgtgcccgaacacgagcgatgctgctggtgcctgtgctgcggctgtgaggtgcgggaacacctgagccatggaaacctgacggtgctgtacggggggctgctggagcatctggccagcccagagcacaagaaagcaaccaacaaattctggtgggagaacaaagctgaggtccagatgaaagagaagtttctggtcactccccaggattatgcgcgattcaagaaatccatggtgaaaggtttggattcctatgaagaaaaggaggataaagtgatcaaggagatggcagctcagatccgtgaggtggagcagagccgacaggaggtggttcggtctgtcttagagcctcaggcagtgccagacccagaagagggctcttcagcacctagaagctggaaagggatgaacagccaagtagcttccagcttacagcagccctcaaatttggacctgccaccagctccagagcttgactggatggagacaggaccatctctgacattcattggccatcaggatataccaggagttggtaacatccactcaggtgccacacctccctggatgatccaagatgaagaatacattgctgggaaccaagaaataggaccatcctatgaagaatttcttaaagaaaaggaaaaacagaagttgaaaaaactccccccagaccgagttggggccaactttgatcacagctccaggaccagtgcaggctggctgccctcttttggccgcgtctggaataatggacgccgctggcagtccagacatcaattcaaaactgaagctgcagcaatgaagaagcagtcacatacagaaaaaagctaatcatgctctctaccaactaccatgaggctaaaagcaaagtcaacaaacccctattataccttccaccaaattctttatcattgtctttcttaggaaacagacatactcattcatttgatttaataaagttttatttttccaaatgta

SEQ ID NO: 175 - DNA, 3805 bp, Homo sapiens
cggctcctctcagcggcggtggcccaggtagaggggtccgcgctggcggcggcggcggcgctgttccccgcgcggtccgcggagcggggtccgggctgcgcgacgtggggcggcggcggcactgcggccccggcccaagcccgaccccgggtcccctcctcggccgccccccgcccggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggttttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttttttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgcaaaaaaaaaaaaaaaaaaaa

SEQ ID NO: 176 - DNA, 1246 bp, Homo sapiens
gtgagggggcgcggtcaccgcccagggttcccacgaacgccaaggcggccacgtcctgctccccctggtgaagaagctgccctgggcttgtcgtcctagggtctccagacatgtctgaggtgaagagccggaagaagtcggggcccaagggagcccctgctgcggagcccgggaagcggagcgagggcgggaagacccccgtggcccggagcagcggaggcgggggctgggcagacccccgaacgtgcctgagcctgctgtcgctggggacgtgcctgggcctggcctgtggcagaaatctgaagctatcatggaacaattgaagtcttttcaaataattgctcatctaaagcgtctacaggaagaaattaatgaggtaaaaacttggtccaataggataactgaaaaacaggatatactgaacaacagtctgacgacgctttctcaagacattacaaaagtagaccaaagtacaacttccatggcaaaagatgttggtctcaagattacaagtgtaaaaacagatatacgacggatttcaggtttagtaactgatgtaatatcattgacagattctgtgcaagaactagaaaataaaatagagaaagtagaaaaaaatacagtaaaaaatataggtgatcttctttcaagcagtattgatcgaacagcaacgctccgaaagacagcatctgaaaattcacaaagaattaactctgttaagaagacgctaaccgaactaaagagtgacttcgacaaacatacagatagatttctaagcttagaaggtgacagagccaaagttctgaagacagtgacttttgcaaatgatctaaaaccaaaggtgtataatctaaagaaggacttttcccgtttagaaccattagtaaatgatttaacactacgcattgggagattggttaccgacttactacaaagagagaaagaaattgctttcttaagtgaaaaaatatctaatttaacaatagtccaagctgagattaaggatattaaagatgaaatagcacacatttcagatatgaattagtttgacattattgagattagactaaggtaatttttttaatgggacctctcatgagaagactggtaaatcaaaaataatgatattttggagcaaaagtcattttatatttaatcctattttgtacagtaaaaataaaactttaaaacaggttgattttccaaaataaatatgctaaaacctaaaaaaaaaaaaaaaaaaaaa

SEQ ID NO: 177 - DNA, 907 bp, Homo sapiens
cgattccgcacgtcccttacccgcttcactagtcccggcattcttcgctgttttcctaactcgcccgcttgactagcgccctggaacagccatttgggtcgtggagtgcgagcacggccggccaatcgccgagtcagagggccaggaggggcgcggccattcgccgcccggcccctgctccgtggctggttttctccgcgggcgcctcgggcggaacctggagataatgggcagcacctgggggagccctggctgggtgcggctcgctctttgcctgacgggcttagtgctctcgctctacgcgctgcacgtgaaggcggcgcgcgcccgggaccgggattaccgcgcgctctgcgacgtgggcaccgccatcagctgttcgcgcgtcttctcctccaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccgcacatgacaatggaccaaatgtgccacacgctcgctcttttttacacccagtgcctctgactctgtccccatgggctggtctccaaagctctttccattgcccagggagggaaggttctgagcaataaagtttcttagatcaatcaaaaaaaaaaaaaaaaaaaa

SEQ ID NO: 178 - DNA, 10091 bp, Homo sapiens
aggttcttggaaggctgtgaggctcggcagtcactgaacttgggagctgaagaatactggacggggcttcggagaggaaggatggtccaggcgcaccccaggggttgcgatgggctcttcttggtgtctgtatggttgctgcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaagaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaagtacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagtatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaatca

SEQ ID NO: 179 - DNA, 2747 bp, Homo sapiens
ggttggaaagacggtgaatggaaaggggatggctggtggtcttgggtgtgatgtgtgttattggtttgtagaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcaaaaaaaaaaaaaaaaaa

SEQ ID NO: 180 - DNA, 601 bp, Homo sapiens
gagtcagtctacaggctaggtgcacactggacagtcagggtggttgtgagctgatggagactgtaaatgaaccagaaacaggtgaagtgagcaaagatgcagtcattgtaaagcaggagaaaaataatgaatattgccttcaggatattgatgataaattgtcagaatcagcagaggatgatggtgaagatgataccaatgatgaagatgatgatgaagatagtaaccctaaaaagaatactcaggccccactagagttaatggcagaatttctgagagcagaaatggcccgagagtaccagctggcaaaaaaattatgtcagatgatcctaatctatgaaccagaaaatcctgaggccaaggagtttttcacacttattgaagaaatgttgctgatggagaaaactcagaatcatgagcaagacggtgaaaacagtgatgaagacagcagtggtgagagtaaaggagaaagcgatgaggagctgagtgacgagagctctgacgaaggtgaagatggatcatgagtgttgctgcaatacttgaagcttcatgtattttcattaatgtataccatgcaaatataaagacaagtgacatttta

SEQ ID NO: 181 - DNA, 1125 bp, Homo sapiens
cctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccctaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagattaataaatgtgcattttgattgtaaaaaaaaaaaaaaaaaaaa

SEQ ID NO: 182 - DNA, 3413 bp, Homo sapiens
ctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctctccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatgaaaaaaaaaaaaaaaaaaa

SEQ ID NO: 183 - DNA, 2407 bp, Homo sapiens
ggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgctctggtaagtatttgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcaaaaaaaaaaaaaaaaaaaaaaaa

SEQ ID NO: 184 - DNA, 2176 bp, Homo sapiens
ggagggggcagttgggcggggataggccgtcctagctaaggtggtaaaggccaataactcttcaggctgcctctcctcgaaaagtcatcttctcgcgaacctttaaaatgccttcctccccaagcacctcaagggactagaactgagtgcttcatttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatgcagtccgagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctactcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcaaaaaaaaaaaaaaaaaaaaaaaaa

SEQ ID NO: 185 - DNA, 1001 bp, Homo sapiens
cgagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcaaaaaaaaaaaaaaaaaaa

SEQ ID NO: 186 - DNA, 1977 bp, Homo sapiens
tgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagaaaaaaaaaaaaaaaaaaaaaa

SEQ ID NO: 187 - DNA, 2736 bp, Homo sapiens
gcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaagacaaagtctctctctgtcacctaggctggagtgctatggcgccatcagggctcactgcagccccaacctccctgggctccagtgatcctcccacctcagcctcccaagtagctgggactacaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattctaaaaaaaaaaaaaaaaaa

SEQ ID NO: 188 - DNA, 1885 bp, Homo sapiens
ccgcgacggcgcgcccccggcggctgctgcggcggcgggagcgaggcgaccgctgaggccgcggagagtgacggcggcccggccgacgggagccggggcggggcggcggcccagcgaaggagcgcgcgggcggtctggccccgccccctccccgcccgccttcccggtgaccttcaggggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagcggctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttcctaaaaaaaaaaaaaaaaaaa

SEQ ID NO: 189 - DNA, 1157 bp, Homo sapiens
accgccagcccgggagagctgccgggagttccccgggagcgctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctaaggggaccatctggaccaagatttggacctagaaatgataaaattaagcatgttcagaatcaagtggatgaagttattgatgtcatgcaagaaaatattacaaaggtaattgagagaggggagagactagatgaactacaggacaaatcagaaagcttatcggataatgcaacagcttttagcaacagatccaaacaacttcgaaggcaaatgtggtggcgtggatgcaaaataaaagccatcatggctttggttgctgctatccttttgctagtgattatcattcttatagtcatgaaataccgtacttgatttgatgacagagatcttcattaaacaagatctgggacagtaataaaagattgctgcataatttaaatgaaacctatgtgtatataactttcaaaacttctttttcaagaaactaagaggcaagtatcacttcaaattggaacgttgagaatgtccaattatcttctccctttctaacaaaatgttcttttaataattatgtttaaggcaaagagaactagcctctatttttccatatttcaaggatctaatttgaaactagatacttgccagttcattatttgtgtatataaacactgattataatatttcatattaatattttaatggcataaggacttgcattattgcattagggagcgggtcatgctggtggtcaggaagcctgtgtagagtaccaaattatatgttgaaagagatgcataaccattctgtcaatatttgcagaaatatagttcctttcatattacagttgttttgcaagcaatttccacatttataggtgtaacaaaagctaaatgttgtaaatgttgttgccctcaggtataactaaaaacattccagtaaatatatttttgactgtgtaaaaaaaaaaaaaaaaaaaaaaaaaaaaa

SEQ ID NO: 190 - DNA, 1218 bp, Homo sapiens
gatcggctcgatgagcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctgggaccatctggaccaagatttggacctagaaatgataaaattaagcatgttcagaatcaagtggatgaagttattgatgtcatgcaagaaaatattacaaaggtaattgagagaggggagagactagatgaactacaggacaaatcagaaagcttatcggataatgcaacagcttttagcaacagatccaaacaacttcgaaggcaaatgtggtggcgtggatgcaaaataaaagccatcatggctttggttgctgctatccttttgctagtgattatcattcttatagtcatgaaataccgtacttgatttgatgacagagatcttcattaaacaagatctgggacagtaataaaagattgctgcataatttaaatgaaacctatgtgtatataactttcaaaacttctttttcaagaaactaagaggcaagtatcacttcaaattggaacgttgagaatgtccaattatcttctccctttctaacaaaatgttcttttaataattatgtttaaggcaaagagaactagcctctatttttccatatttcaaggatctaatttgaaactagatacttgccagttcattatttgtgtatataaacactgattataatatttcatattaatattttaatggcataaggacttgcattattgcattagggagcgggtcatgctgggggtcaggaagcctgtgtagagtaccaaattatatgctgaaagagatgcataaccattctgtcaatatttgcagaaatatagttcctttcatattacagttgttttgcaagcaatttccacatttataggtgtaacaaaagctaaatgttgtaaatgttgttgccctcaggtataactaaaaaaaaaaaaaaaaaaaaaaaaaaaaaa

SEQ ID NO: 191 - DNA, 1378 bp, Homo sapiens
gctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttctaagcaaaaaaaaaaaaaaa

SEQ ID NO: 192 - DNA, 3572 bp, Homo sapiens
ggctgcggaggaccgaccgtccccacgcctgccgccccgcgaccccgaccgccagcatgatcgccgcgcagctcctggcctattacttcacggagctgaaggatgaccaggtcaaaaagattgacaagtatctgtatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaaaaaaaaaaaaaaaaa

SEQ ID NO: 193 - DNA, 3779 bp, Homo sapiens
atcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcattaaaaaaaaaaaaaaaaaaa

SEQ ID NO: 194 - DNA, 1637 bp, Homo sapiens
gtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccaggacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaaaaaaaaaaaaaaaaaaaaaaaaaaaaaaaaaaaaaaaaaaaaaaaaaaaaa

SEQ ID NO: 195 - DNA, 1728 bp, Homo sapiens
acgcgagctgactgagggccggagcggagcgaggcgacgcggggaggggcgagggatcgcggccggtggctgggggccacctgctccccgagcaccggcccccgctccggggagcagagtccggagcgggatccgcggcccacaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgataaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgcctaaaaaaaaaaaaaaaaaa

SEQ ID NO: 196 - DNA, 2033 bp, Homo sapiens
cctccttccagtgcccggcgttcctcccttccccctcgccgccgaccgagttcttccttttcagaccgggtcgccttgctgtcgtcgcggtgattttcctgctactgctactgctgctgctgccaccgccactaccactgggctcatttgccccgaccccttcccgccgccccgcccccagccccacacaagatgtcagaggatttagcaaagcagctggcaagctacaaagctcagctccagcaagttgaagctgcattatctggaaatggagaaaatgaagatttgctaaaattgaagaaagatttacaagaagttatagaactaaccaaagaccttctgtcaactcaaccttctgagacgcttgcaagttcagacagttttgcttctactcaacctactcattcatggaaagtaggagacaagtgtatggcagtctggagtgaagatggacagtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagcacttagatgaattattgatcttcctaatatcaggcgcctacttaacctatggtgtgtactttttgtaagttgtaacttgaaattttcagatgctttgaacttgacacatactctagcaattcattggaacaccaaggcaaaaacaccaacctgctaaaagagatcttttcatttttcttattttcagctttaaaacttagctgtcgttcagttaagcttaaagataggttaatttgtaaatggcaaagtttgttttgaggtttttcctcaataacttgtttcccaggcctattaggccatctctaaaattgatctagctgttttatttttatgtactcttagttttatgtaagaaaccttaggatgagctcccttttctaaggtgtttttgttttttgtatgtttgcttttttcctgttttttgttttttccatttacggcagtggtaccatgttttggatgtgtgatgtttatatgggagaacaaaaagctgatgtatagccctgtatacagtgtagatactatttttgtaaaaacacaaggctaaattaatgaacaagaatactgaatatttcatcattaaaaatttcttgtatttcttgtgcattaatctgacgataatttccctgtatattatgttcatttagctgtttgtaatttttgttaattagatcaggttgtctgcatttgttggtgtaagtgaacatcatcacagttatcctgagttgagtttaagccaaatacatgcatagaaaagggtcttcctattaatggaagaaggtaatttttaggatgtgtattatttcagttttgtatgtttaacttttattaaataaagtgtttttaaaatctccaaaaaaaaaaaaaaa

SEQ ID NO: 197 - DNA, 2469 bp, Homo sapiens
ggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttaaaaaaaaaggagcgtctctgcccggcctccccgtctgagaagtgaggaaaccctctgcctggcaaccgccccgtctgagaagtgaggagcccctccgtccggcagccaccccgtctgggaagtgaggagcgtctccgcccggcagccaccccgaccgggagggaggtggggggggggggtcagccccccgcccggccagccgccccgtccgggaggtgaggggctcctctgcccggccgcccctactgggaagtgaggagcccctctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggtgggggggtcagccccccgcccggccagccgccccatccgggagggaggtgggggggtcagccctccgcccggccagccgccccgtccgggagggaggtggggggggtcagccccccgcccggccagccgccccgtccgggagggaggtggggggatcagccccccgcctggccagccaccccgtccgggaggtgaggggcgcctctgcccggccgcccctactgggaagtgaggacccctctgcctggccagccgccccgtccgggagggttgggggggggtcagccccccgcccggccagccgccccatccgggaggtgaggggcgcttctgcccggccgcccctactgggaaatgaggagcccctctgcccggccacgaccccgtctgggaggtgtgcccagcggctcattggggatgggccatgatgacaatggcggttttgtggaatagaaaggcgggaagagtggggaaaaaattgagaaatcggatggttgccgggtctctgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctactgaccttccctccactattgtcctatgaccctgccaaatccccctctgcgagaaacacccaagaatgatcaataaaataaataaataaataaataaataataaaaaaaaaaaaaaaaaaaa

SEQ ID NO: 198 - DNA, 1027 bp, Homo sapiens
cccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagccaaaaaaaaaaaaaaaaaaaaaaaaaaaaaaaaaaaaaaaaaaaaaa

SEQ ID NO: 199 - DNA, 3479 bp, Homo sapiens
gacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactcttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctataggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtttgttccaggggttgcctctccttatctacggggattactttgtacatgcagataagttttcgcaaacctatttccattttcttttgtaagcaaataaaactttaaaacaaaaaaaaaaaaaaaaaa

SEQ ID NO: 200 - DNA, 2815 bp, Homo sapiens
gaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaaaaaataaaaaaaaaaaaaaa

SEQ ID NO: 201 - DNA, 2581 bp, Homo sapiens
gaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 202 - DNA, 839 bp, Homo sapiens
gtcgtggtttgtgcgcggccaggcgctggagcctccgctgccgggagcaatcagaccttccagctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaagattctgccatgtaaatgtcagcttgagtggactccagctgagaagaaagagaagaaagacttaattattgaataatttgtcagaggataaactcccaacctagacctttcacttaaaatagtgtgaatttgtatatgtttttaaaagaaccagtactggccgggtatgctggcttttacctgaaatcccagcactttgggaggccgaggcgagtggatcgcctgagatcgggagtttgagaccagcctggccaacatggtaaaatcctgtctctactaaaaatataaaaattagccaggtgtagtggcgcgcgtctgtaatcccagctactcgggaggctgaggcaggagaattgcttgaatccgggaggtggaggttgcagtgagcctaggtcgtgccactgccctccagcctgggtgacagagcgactgcgtctccaaaaaaaaaaaggtaaaattaaaattaaaaaaaataataataaccagtattttgtttactaaaataaaatgcctttgtaaaaaaaaaaaaaaaaaa

SEQ ID NO: 203 - DNA, 1320 bp, Homo sapiens
ggggaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgcaaaaaaaaaaaaaaaaaaaaaaaaaaaaa

SEQ ID NO: 204 - DNA, 2265 bp, Homo sapiens
gcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactccacacaccatgaatctactaaagcagcacctggagattactggtgggcaggtacgtacccggttcccgccagaacccaatggaatcctgcatattggacatgccaaagccatcagtttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctaaaaaaaaaaaaaaa

SEQ ID NO: 205 - DNA, 2307 bp, Homo sapiens
ctcgcgtttccggccggaaggcttctccagcctttcccggaagctgcgctcgctacccgggtaacgggtcccggctgtggaagctcccgcggcgccgcgatggacctcgaggagtcggaagagtttaaagaacgctgtactcagtgtgctgctgtctcatggggtcttactgatgaaggcaaatattattgcacttcttgccacaatgttacagagagatatcaggaagttacaaacactgatcttattcctaatacccaaataaaagccctcaaccgggggcttaaaaaaaaaaacaatactgaaaaaggctgggattggtatgtgtgtgaaggtttccagtatattctttatcaacaagcagaagccttaaagaaccttggagtaggcccagagttaaagaacgatgttttacataatttttggaagcgctaccttcagaagagcaagcaggcatattgtaagaacccagtttataccactggaaggaaacctacggtattagaagataatctaagtcattcagactgggctagtgagcctgagctgctaagtgatgtcagctgtcctccttttcttgaaagtggagcggagtctcagtctgacatccacactcgaaaacctttccccgtcagcaaagcatcacaatcagaaacgtctgtctgctctggatctctggatggagttgaatactcacaacgaaaggagaagggaatcgtgaagatgaccatgccacagacacttgccttctgttatctgtccttactttggcagagagaagcaataacactttcagatcttttgaggtttgttgaagaggaccatattccttacataaatgcttttcagcattttccagaacagatgaaattatatggacgtgacagaggaatctttggtatagagtcttggcctgactacgaggacatctataaaaaaacaatagaagttggaacatttttagatttgcctcgttttccagacataactgaagactgctatcttcatcccaacatactgtgtatgaaatacttgatggaagtcaacctccctgatgaaatgcatagcttaacttgccacgtggtaaaaatgactggaatgggagaagtggattttctgacatttgatcctatagccaaaatggcaaaagctgttaagtacgatgtacaagctgtagctatcattgtggtggtattgaaactgctctttctattggatgacagtttcgagtggtctttgtctaatcttgctgaaaagcataatgaaaagaacaaaaaagataagccatggtttgatttcagaaagtggtaccaaattatgaagaaagcttttgatgagaaaaaacaaaaatgggaagaagcaagggccaagtacctgtggaaaagtgaaaagccactctactactcatttgtcgacaaaccagtagcatataaaaaaagagaaatggtggtgaatctacagaaacaatttagcacactggtcgattcaacagcaactgctggaaaaaaaagcccttcaagttttcagttcaactggactgaagaggacactgatagaacgtgtttccatggacacagccttcagggagtcctgaaagagaaaggccaatcactgctgactaagaattcattatattggcttagtacacagaaattctgcagatgctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaagaaagaaatcaagatccaagaaagtgagacgacattgagaaaatgaaatagaaactttctggaaaaatattttaatagtgataataacatcagattttaatataacattccagagaattgtggaaaatactgcatatatatgtatagactctgacacatatttacatatatatcaagtgtgcttagaaaaatgtatattgtaaagcaggtgagcttcatttgattttatttttcagagtatgaacattctaagagaaagttaaaacaatagcaaattgtataattgtatccagaaatgtatactcatcatattttaaagctaaatttattttttaaactagatcccttcattattctttatgccccagagtaaatcccagatggatcaaagatctaaacataatctttcatatgtaaaaatataaaagtattagtagaaaacaaatatgaatgctttgatgaaaaaaaaaaaaaaaaaa

SEQ ID NO: 206 - DNA, 1796 bp, Homo sapiens
aaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagacaggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgacgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctcaaaaaaaaaaaaaaaaaaaaaaaaaaaaaaaaaaaaaaaaaaaaaaaaaa

SEQ ID NO: 207 - DNA, 2721 bp, Homo sapiens
gaggctggaggagggcacgtcggcgcctcggcgaggatgggagtccccaggacccggagctgagcagcctggcgcgcggcgggcagggcgcgcaggacagaagcctcgctgttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcatgaatacatcttcaagaagcccactttctgtgatgtctgcaaccacatgatagtgggaacaaatgctaagcatggactgcgctgcaaagcctgtaagatgagcatccaccacaagtgcacagatggcctggcaccccagcggtgcatgggcaagctgccaaaggggtttcggcgttactacagctcccccttgctcattcatgaacagtttggctgcattaaagaagttatgcccattgcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggccaggagacataattactcttttagaggattccaatgaagactggtggaaagggaaaattcaagacagaattggcttctttccagccaactttgttcagagactacaacaaaatgagaagatttttagatgtgttagaaccttcattgggtgtaaggaacaggggcagataacactgaaagagaatcagatctgcgtgagttctgaagaagaacaagatggttttatcagagtcctcagtggaaaaaagaaaggcctcatcccccttgatgtactagaaaacatctgattgctggctcctcctccgtttgcagtaggcaagctctgctgcgatgcctctgcctcatctcacactgcgtcaacccaaaggagctgccgcactgacccagccccccaggaaacagtgagacaagaatcaagtatctgagactgtggagtaatagccacaaaacagagggcccactgcacagcatatccaggctgccacaggtggggacgaggctgagagagtcagcaggcagagccagatgccatgcttggcagcagcagtaggactataaaccacagctgtcccccaggatcccactcctttcctgtctgtgtggtgtaagttaacacactggagtgtgctccagtttgcagggtagcccagtgcaaggttcagatccatgtagctaagtattatcctgcttccagacctatgtcaccagtaccaatcagtcagtgtcatcacatttcaggccccaagcaatctctgtgcaaagcatcagaaagacctgcttcccagcccccagcattccagtgctctccaggcttcctctctttgtgattgtgctgtccagagtgtccagcttgttctttctttctcttcagtcctctgagtacatctggtggtgtgcattagatgtgagggctatgttgacatggcatcacctccaaagacctgacctgcctaaagactgatgacaggccatccttcctgctgttctaggtactggcctgggtgacagagcaggacatgagacatagatacagtggggaggagaagtggggaaaggtggagcagagagttcttacttattgaagattatacagccctttcggttatgaagtccctgcttgaaggcaatggacctggggaagagactatcacaaaaagtctccattttcattttacatcctctctattggaggcagcacttttccctcatgctgtcctataggactccactttgaaggttgtgcctacgttgcagggaactaggaacatggaggggaaccaacaacagcatcttagaagaaatgtagccaaattggagtccattcttctttagggcagtatatgaaatcctagcagatgtaaaatggaaaagaatcctaatgcttcttccttcagaaagtagaggaactaggggcccaattagcatcatctaggggaatctctattactctgtacttatactaatgtttacaagaatgcaatatactgtgatgccttcctactcaagcctcctagcattcaaacttccatcctattagtcattaacatggttaaacttcaattcacaatcaccttggaatcaatgtcagtttgatttattttgttacagagcaataaaatcattagaacaatgaaaaaaaaaaaaaaaaaa

SEQ ID NO: 208 - DNA, 1757 bp, Homo sapiens
gccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaaaaaaaaaaaaaaa

SEQ ID NO: 209 - DNA, 1134 bp, Homo sapiens
atatgaggttggggagcggctgagtcggccttttccgcccgctcccccctccccccgagcgccgctccggctgcaccgcgctcgctccgagtttcaggctcgtgctaagctagcgccgtcgtcgtctcccttcagtcgccatcatgattatctaccgggacctcatcagccatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaagagaataaaaagagactcattcagtgccaaaaaaaaaaaaaaaaaaaaaaaaaaaaaaa

SEQ ID NO: 210 - DNA, 1216 bp, Homo sapiens
gggatagaagagtttatgcaaagggagaaacaaaccataacatacaacaagaaagtcgtacattttgtaaggaggaatttggattaacatctttaggaaacacgagttttacagacttttcttgcaaacatcctagagaactgcgagaaaagattcctgttaagcagcccaggatctgctctgaaaccaggtctctaagtgaacatttctcaggcatggatgcatttgagagtcaaattgttgagtcgaagatgaaaacctcttcatcacatagctcagaagctggcaaatctggctgtgacttcaagcatgccccaccaacctatgaggatgtcattgctggacatattttagatatctctgattcacctaaagaagtaagaaaaaattttcaaaagacgtggcaagagagtggaagagtttttaaaggcctgggatatgcaaccgcagatgcttctgcaactgagatgagaaccaccttccaagaggaatctgcatttataagtgaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaaaaaaaaaaaaaaaaaaaaaaaaaaaaaa

SEQ ID NO: 211 - DNA, 2808 bp, Homo sapiens
gctcggttcacccacaaggaatgagagctgcctgcctgctgctgcttggagagccccagacagtcgcttgaagaggtgtgtggatgtctcctagatcttgacttgctcctgaggaaatattgtgtgactgagtttcctgttatactgctctccaatccatcatgaaccagccagagtctgccaacgatcctgaacccctgtgtgcagtgtgtggccaagcccactccttggaggaaaaccacttctacagctatccagaggaagtggatgatgacctcatctgccacatctgcctgcaggctttgctggaccccctggacactccgtgtggacacacctactgcaccctctgcctcaccaacttcctggtggagaaggacttctgtcccatggaccgcaagcctctggttctgcagcactgcaagaagtccagcatcctggtcaacaaactcctcaacaagctactggtgacctgcccattcagggagcactgcacccaggtgttgcagcgctgtgacctcgagcatcactttcaaaccagctgtaaaggtgcctcccactacggcctgaccaaagataggaagaggcgctcacaagatggctgtccagacggctgtgcgagcctcacagccacggctccctccccagaggtttctgcagctgccaccatctccttaatgacagacgagcctggcctagacaaccctgcctacgtgtcctcggcagaggacgggcagccagcaatcagcccagtggactctggccggagcaaccgaactagggcacggccctttgagagatccactattagaagcagatcatttaaaaaaataaatcgagctttgagtgttcttcgaaggacaaagagcgggagtgcagttgccaaccatgccgaccagggcagggaaaattctgaaaacaccactgcccctgaagtctttccaaggttgtaccacctgattccagatggtgaaattaccagcatcaagatcaatcgagtagatcccagtgaaagcctctctattaggctggtgggaggtagcgaaaccccactggtccatatcattatccaacacatttatcgtgatggggtgatcgccagagacggccggctactgccaggagacatcattctaaaggtcaacgggatggacatcagcaatgtccctcacaactacgctgtgcgtctcctgcggcagccctgccaggtgctgtggctgactgtgatgcgtgaacagaagttccgcagcaggaacaatggacaggccccggatgcctacagaccccgagatgacagctttcatgtgattctcaacaaaagtagccccgaggagcagcttggaataaaactggtgcgcaaggtggatgagcctggggttttcatcttcaatgtgctggatggcggtgtggcatatcgacatggtcagcttgaggagaatgaccgtgtgttagccatcaatggacatgatcttcgatatggcagcccagaaagtgcggctcatctgattcaggccagtgaaagacgtgttcacctcgtcgtgtcccgccaggttcggcagcggagccctgacatctttcaggaagccggctggaacagcaatggcagctggtccccagggccaggggagaggagcaacactcccaagcccctccatcctacaattacttgtcatgagaaggtggtaaatatccaaaaagaccccggtgaatctctcggcatgaccgtcgcagggggagcatcacatagagaatgggatttgcctatctatgtcatcagtgttgagcccggaggagtcataagcagagatggaagaataaaaacaggtgacattttgttgaatgtggatggggtcgaactgacagaggtcagccggagtgaggcagtggcattattgaaaagaacatcatcctcgatagtactcaaagctttggaagtcaaagagtatgagccccaggaagactgcagcagcccagcagccctggactccaaccacaacatggccccacccagtgactggtccccatcctgggtcatgtggctggaattaccacggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaactaaaatgatttgtataccccactgaattcaagctgatttaaatttaaaatttggtatatgctgaagtctgccaagggtacattatggccatttttaatttacagctaaaatattttttaaaatgcattgctgagaaacgttgctttcatcaaacaagaataaatatttttcagaaaaaaaaaaaaaaa

SEQ ID NO: 212 - DNA, 3185 bp, Homo sapiens
ggcagccagagcgcggaagaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcggtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagtgtccagcagccagcaccaggcggcattccttcatctctggtggacggtctaccagaacaacgtgctgcccctttataaaagcgtccaagcgggggaagcacgcgcgtctcctggtcacacactttgccgcagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatatgatagcttgtcctgaaactgagactcctgccgtgataacgtgtgacccactgtcccagccttcccctcagcctgcagacttcacagagactgaaaccatcttgcagccagcaaataaagtcgaaagtgtctcatccgaggaaaccttcgaaccaagccaggaactccctgctgaggctctcagggaccccagtctgcaggatgcactggaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatcgttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgatgctcgtaggatatttcaggtgagtcagggttggatggtcatcggctttcagagggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacagcaaaaaaaaaaaaaaaa

SEQ ID NO: 213 - DNA, 1753 bp, Homo sapiens
cccgggcccgaccgtcatggagcggtgcggggcctacgcctgttccgtgtgaggcgcatcgctgccgccgccgccgacgccgccttcgtttgtcgaggcctccggaacccccgccgcctcccggagcccctcgcccttggcagcctgtcaccgccccctgggcgggctcgaatgcgcgtccggtgaaggtgcaggcccggcgccgccactgccgcagccaggagatggttcgggcctagcggagccgggactggagcaacatgaaccgtgaagaccggaatgtgctgcgtatgaaagaacgggaaaggcggaatcaggaaattcagcagggcgaagacgccttcccacctagctctcctctctttgcagagccatacaaagttactagcaaagaagataagttatcaagtcgtattcagagtatgcttggaaactacgatgaaatgaaggatttcataggagacagatctataccaaagcttgttgcaattcccaagcctacagtaccaccatcagcagatgaaaaatctaacccaaatttctttgaacagagacatggaggctctcatcagagtagcaaatggactccagtaggacccgcacccagcacttctcagtctcagaaacggtcctcaggcttacagagtggacatagtagccagcggaccagcgcaggtagcagtagtggcactaacagtagtggtcagaggcacgaccgtgagtcatataacaatagtgggagcagtagccggaaaaaaggccagcatggatcagaacactccaaatcacgttcttccagccctggaaaaccccaggctgtttcttcattaaactctagtcattccaggtctcatgggaatgatcaccatagcaaggaacatcaacgctccaaatcacctcgggaccctgatgcaaactgggattctccttcccgtgtacctttttcaagtgggcagcactcaactcaatctttcccaccctcattgatgtcaaagtccaattcaatgttacagaaacccactgcctatgtgcggcccatggacggacaggagtccatggaaccaaagctgtcctctgagcactacagcagccaatcccatggcaacagcatgactgagctgaagcccagcagcaaagcacatctcaccaagctgaaaataccttcccaaccactggatgcatcagcttctggtgatgtgagctgtgtggatgaaatcctaaaagagatgacgcattcatggcctccccctctaacggctattcatacaccatgcaaaacagaaccttccaaatttccttttccaactaaggagtctcagcagtccaattttggcactggagaacaaaggctcaagtgatcctcctgcctcagcctactgagtagctgggactgtgggcacatgccactatgcctggctgattttttaaatttttagtagagatagggtctcactatgttgcacaggctggtctcgaactcctgagctcaagtgatccacctgcctcgcctcccaaagtgttgggattactggtgtgagccaccatgccctcgtatcctaatttttatgatctaatgggtagtagtgggttgagctgaaaaattgttatgctttaaaaaattcaagaactgtaagtcattggagatcaaaatacactacttttattaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 214 - DNA, 4395 bp, Homo sapiens
gtagtcgtggcgctctcgaggccctgccatgagcaagctcttaactcttcaggtctgcacgtcctacgcccaccgtccagtgctactctcagctcggagttcagcttcgggctgccaagagccagcaacctggtgtcagaggctcggtcccacaacgctctgcgggccgcggcgcctgctgggaggtgtagtccccgatctgcgtactgcgttcgccgagggggagggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgaacacttcagttatggaagatcaaaatgaagatgagtccccaaagaaaaatactctttggcagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgttgtattaggaacatgttggacagtggaaaattttctctggattgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggcccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaaaaaaaaaaa

SEQ ID NO: 215 - DNA, 2453 bp, Homo sapiens
cgagcggtgagcgatcgatactcctatgctagcctctggctcctcaggggacacagccgagtggtcggaccaaacgcaacgagtcttcgccagcccaaaggcgactcgacaccgtcccagctgaagagaggcacgggactgaaccagctggtggtggcccgatggctggagacacccactgccccgcagagcccctggccagagaaggcactttatgggaggccctcagggcgctcctgccgcacagtaaagaagacctgaagttggacctcggggagaaagtggagaggagcgtggtgacattgttgcagcgagccactgagctcttctacgagggcaggagggacgagtgtctgcagagcagcgaggtgatcctggactactcctgggagaagctcaacacgggcacatggcaggacgtagacaaagactggcgccgggtctacgccatcggctgcctcctgaaagccctgtgtctgtgccaggcacctgaggatgccaacactgtggccgcagccctgcgggtctgtgacatgggcctgctgatgggggcagccatcctgggggacatccttcttaaagtcgctgccatcctccagacacacctccctggaaagaggcctgcccgtggctccctcccagagcaaccctgcacaaagaaagcaagggcggaccatggtttgattccagatgtgaagttagaaaaaacagtcccccggctgcaccgtccgtccctccagcatttcagggagcagtttttggttccagggaggcccgtgatcctgaaaggcgtggctgaccactggccgtgcatgcagaagtggagtttggagtatatccaggagatcgctggctgccgaactgtcccagtggaagttggttcgaggtacacagatgaggaatggtcccagaccctcatgacggtcaacgagttcatcagcaaatacatcgtgaatgagccaagggacgtcgggtaccttgctcagcaccagctctttgaccagatcccggagttgaagcaggacatcagcatccccgactactgcagcctgggcgatggggaggaggaggaaatcaccatcaatgcctggtttggtccccagggaaccatctccccactacatcaggatccccagcaaaacttcctagtgcaggtgatggggaggaagtacatccggctgtattccccgcaggagtcaggggctctgtaccctcatgacacgcaccttctccataacacgagccaggttgacgtggagaatcccgacctggaaaagttccccaagtttgccaaggccccattcctgtcctgcatcctgtctcctggagagatcctgttcatcccggtgaaatactggcattacgtgcgggctctggatttgagcttctcggtcagcttctggtggtcgtagccaggataggagctgaaagggcctgacatgcagacagcattcatctgttcactaatttcctgggtcctggaatctatagagacaagcaggactgaacctgtgtcctgaagagccttcactgcccagtggcagccctggggggctgagctccagcactggacaggcacagagcaggggctgcccaggaaggagcacactccaggccaggggtgcatggcagaggaaggtggggagagcccagaaggacattgcagacagacagcctgcatggggactctggcatcagaaagccgaatgtttttgggaaacgggtgggtcacacaggcaggggtgaaacatgggctctgaggttggctacctgattcaaacccggccgcgctgcgcacctgctgggtgacttggccaggatcccccacttcgctgtgcccatatggaaaagagggcaaggccagtcctcactgccgagggccgagaaggcggtgccgagcccctgctgctgcatgaaccttagccgctgtcactgatcccaattactctgatccttttgcccttccttcccataacggcctgctggacgccacagcctgaatactggagagagctgggcattgcccaggtcacaggagagagtccgtagagacctgcgcaggagccgggacccctgctgagcagtgggagctttctgtcatccccatggctcaaggataacctacctgcctgcagagaagagcgaaggtcttgctggatgacttttcacccgcactcacccaggagcaggctcccaagtgaagaaaccaccaaaccatcaccagctcctagaagcctccctcccaccaccttctagtcaccatcccccagaagtaatgactctcaaacctgggggatttgaggccagggggagagccaggctctatgctttctgtaattgtgtctcgtttgtgtgcacgcaggtttgttttatgttttggccattaagattttccccagccaaaaaaaaaaaaaaaaaaaaaaaaaaaaaaaaaaaaaaaaaaaaaaaaaaaa

SEQ ID NO: 216 - DNA, 3204 bp, Homo sapiens
agcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtacctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccaaaaaaaaaaaaaaaa

SEQ ID NO: 217 - DNA, 2124 bp, Homo sapiens
gctccgcaatcatcttctttaccctggagctgctgctgctgctgctgcttttgcttttggggctgagtttaataagcgagcgagcgagcaagcgagcgcggggggaaaaaggcagagaatgtccgccatctaccctccgctcctgggcgcgctctcattcatagcagcctcttcatgaattacagctgagggggggcggaggaggggggggtaccacacaacaccccagcaaacctccgggcccccaggcatggctagctcgtgtgccgtgcaggtgaagctggagctggggcaccgcgcccaggtgaggaaaaaacccaccgtggagggcttcacccacgactggatggtgttcgtacgcggtccggagcacagtaacatacagcactttgtggagaaagtcgtcttccacttgcacgaaagctttcctaggccaaaaagagtgtgcaaagatccaccttacaaagtagaagaatctgggtatgctggtttcattttgccaattgaagtttattttaaaaacaaggaagaacctaggaaagtccgctttgattatgacttattcctgcatcttgaaggccatccaccagtgaatcacctccgctgtgaaaagctaactttcaacaaccccacagaggactttaggagaaagttgctgaaggcaggaggggaccctaataggagtattcataccagcagcagcagcagcagcagcagtagcagcagcagcagcagcagcagcagcagcagtagcagcagcagcagcggcagcagcagcagcagtagcagcagcagtagcagcagcagcagcagcagtagtaccagtttttcaaagcctcacaaattaatgaaggagcacaaggaaaaaccttctaaagactccagagaacataaaagtgccttcaaagaaccttccagggatcacaacaaatcttccaaagaatcctctaagaaacccaaagaaaataaaccactgaaagaagagaaaatagttcctaagatggccttcaaggaacctaaacccatgtcaaaagagccaaaaccagatagtaacttactcaccatcaccagtggacaagataagaaggctcctagtaaaaggccgcccatttcagattctgaagaactctcagccaaaaaaaggaaaaagagtagctcagaggctttatttaaaagtttttctagcgcaccaccactgatactcacttgttctgctgacaaaaaacagataaaagataaatctcatgtcaagatgggaaaggtcaaaattgaaagtgagacatcagagaagaagaaatcaacgttaccgccatttgatgatattgtggatcccaatgattcagatgtggaggagaatatatcctctaaatctgattctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggtttttttttttttttggttgtgattttttgttcttgttgtttatatgaaaacactcaaaatgatgcaaccaaaagggaaaaaataaaaatcaaacaacctccaaaaaaaaaaaaaaaa

SEQ ID NO: 218 - DNA, 1220 bp, Homo sapiens
ggaaacagtgctgcaggcatacagtgacaacaggacatcaggaaatgcccaagaagtttgttaggtgctgtgtcatgaatcaagtcttcattttaatgtgttctaattgttgtaaaacaagagggaatggtatttggaatttagctatatttatcttctcaatcaaattctacttcagaggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacacatctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagtaccatggctattgtcctgactgtgatacccggtataacataaaaaacagggaggtccacttacacagtgaacctgtccacccaccgggaaagattcctcaccaaggccctcccctccctcctacaccccatctccctcctttcccactagaaaatgggggaatgggaataagccacagtaacagcttcccccctatcagacctgcaactgtgcctcctcccactgcaccaaaaccacagaagacgatcttgaggaagtcaaccactacaaccgtgtgatgtatgccattaaaaaaattgtttttttaattttctatattataaacataaaataagtaatgagcactttctactcaagcaataaaaagcccaaatatattaatcctgcattcagcaaagtggcataaaaatcacctggtaagtatgcagcacattgcttatatcctgggtatgcattattttaaatgttgtatcattaaaaacctcagaatgatgaaaaaaaaaaaaaaaaaaaaaaaaaaaaaaaaaaaaaaaaaaaaaaaaaaaaaaaaaaaaaaaaaaaa

SEQ ID NO: 219 - DNA, 2931 bp, Homo sapiens
aattccgcgcgagtggcgcggggggctgcttgtgttccagggggagctgttcacgcggtccccggccccgctctgaagtctcccaactcacccggcttgtctcccgcccccgccttactggggagagggaggcccttggtgaaaggcatgggagccccgctgccgacggggagagatggggcgccccccctccgccccgtcggagagctgagaaacttgctgggaaggttctgggctgagggtggcctcttttggttgggcgccgttggggaggggccggggccgctctgagcgcggtctcatgcccccgccccctcccctgtcttgtcttcgcgggctccaggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaagagaaggacagcttgagccgatacgacagtgatggggacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgataggtataatggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctacctatggccgatcgccaatggttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcacccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacagtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacaaaaaaaaaaaaaaaa

SEQ ID NO: 220 - DNA, 1594 bp, Homo sapiens
ccctcctcttcctgttcttggtcaattccggtcttgtttccccaacaaatgccgtcgtttccggggctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccgttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtggggcagcccccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctgaaaaaaaaaaaaaaaaaaaaaaaaaaaaaaaaaaaaaaaaaaaaaaaaaaaaa

SEQ ID NO: 221 - DNA, 5049 bp, Homo sapiens
ggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcagaatgaagacctaaatgacctcagcaaatcctcttctaactcatgggtacccagactctaaatatttcatgattcacaactaggacctcatatcttcctcatcagtagatggtacgatgcatccatttcagtttgtttactttatccaatcctcaggatttcattgactgaactgcacgttctatattgtgccaagcgaaaaaaaaaaatgcactgtgacaccagaataatgagtctgcataaacttcatcttcaaccttaaggacttagctggccacagtgagctgatgtgcccaccaccgtgtcatgagagaatgggtttactctcaatgcattttcaagatacatttcatctgctgctgaaactgtgtacgacaaagcatcattgtaaattatttcatacaaaactgttcacgttgggtggagagagtattaaatatttaacataggttttgatttatatgtgtaattttttaaatgaaaatgtaacttttcttacagcacatcttttttttggatgtgggatggaggtatacaatgttctgttgtaaagagtggagcaaatgcttaaaacaaggcttaaaagagtagaatagggtatgatccttgttttaagattgtaattcagaaaacataatataagaatcatagtgccatagatggttctcaattgtatagttatatttgctgatactatctcttgtcatataaacctgatgttgagctgagttccttataagaattaatcttaattttgtattttttcctgtaagacaataggccatgttaattaaactgaagaaggatatatttggctgggtgttttcaaatgtcagcttaaaattggtaattgaatggaagcaaaattataagaagaggaaattaaagtcttccattgcatgtattgtaaacagaaggagatgggtgattccttcaattcaaaagctctctttggaatgaacaatgtgggcgtttgtaaattctggaaatgtctttctattcataataaactagatactgttgatcttttcttctgtcccctccccccaccacttctgtaagtttcctgctctattcccaccatttttttctgtgcacacattatgatatatttcatttcctgcattgtcttgagaaagatggtaaggcaagtgagctgttgctaaccagaaattaaaattccagtaagtgtttttcattatgaaaaaaaaaaaaaaaaaaaaaaaaaaaaaaaaaaaaaaaaaaaaa

SEQ ID NO: 222 - DNA, 5888 bp, Homo sapiens
atatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaatggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagtcgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgataaaaaaaaaaaaaaa

SEQ ID NO: 223 - DNA, 2181 bp, Homo sapiens
cggggtggcagtgcggcgggttacggcctggtcagaccataatgacttcagcaaataaagcaatcgaattacaactacaagtgaaacaaaatgcagaagaattacaagactttatgcgggatttagaaaactgggaaaaagacattaaacaaaaggatatggaactaagaagacagaatggtgttcctgaagagaatttacctcctattcgaaatgggaattttaggaaaaagaagaaaggcaaagctaaagagtcttccaaaaaaaccagagaggaaaacacaaaaaacaggataaaatcttatgattatgaggcatgggcaaaacttgatgtggaccgtatccttgatgagcttgacaaagacgatagtacccatgagtctctgtctcaagaatcagagtcggaagaagatgggattcatgtagattcacaaaaggctcttgttttaaaagaaaagggcaataaatacttcaaacaaggaaaatatgatgaagcaattgactgctacacaaaaggcatggatgccgatccatataatcccgtgttgccaacgaacagagcgtcagcatattttagactgaaaaaatttgctgttgctgagtctgattgtaatttagcagttgccttgaatagaagttatacaaaggcttattccagacgaggtgctgctcgatttgctttgcaaaaattagaagaggccaaaaaagattatgaaagagtattagaactagaaccaaataactttgaagcaacaaatgaactcaggaaaatcagtcaggctttagcatccaaagaaaactcatatccaaaggaagctgacatagtgattaagtcaacagaaggagagcgaaagcaaattgaagcacaacagaataagcagcaggccatttcagagaaagatcgggggaatggatttttcaaagaggggaaatatgaaagagcaattgaatgctatactcgagggatagcagcagatggtgctaatgcccttcttccagctaacagagctatggcctatctgaagattcagaaatatgaagaagctgaaaaagactgcacacaagccattttattagatggctcatattctaaagcttttgccagaagaggaactgcaagaacatttttgggaaagctaaatgaggcaaaacaagattttgaaactgttttacttctggaacctggaaataagcaagcagtaactgaactctccaaaattaaaaagaaaccactcaagaaggttattattgaagaaactggtaatttgatacagactattgatgtgccagatagcactactgctgctgctccagagaataatcctattaatctagcaaatgtaatagcagccacaggcaccacaagtaagaagaattcaagccaagatgacctttttcccacaagtgatactccaagagcaaaagtattgaaaatagaagaagtcagtgatacttcatccctgcaacctcaagccagtttgaagcaggatgtatgtcagtcttacagcgagaaaatgcccatagagatagaacaaaaacctgctcagtttgccacaactgttcttcctccaattcctgcaaactcgttccagctcgaatctgatttcagacaattgaaaagttctccagatatgttgtatcagtatttaaagcaaattgaaccatctttgtatcctaagttgtttcagaaaaatctggatccagatgtattcaaccagatcgttaaaattctgcatgacttttacattgagaaagaaaagccattactcatctttgaaatcttacaaagactttctgaactaaaaaggtttgatatggcagtgatgtttatgtcagaaacagagaaaaagattgcacgtgcattatttaatcacatagacaagtcaggattgaaggatagttctgtcgaagaactcaagaaaagatacggtggttgatttccatttttgctgaaataattgtttttgactttcatatgtaaattttttctactgaaagtgttttgctttttaagaaaatgaaattatatagcaggaaaggactatctttgaacataagttaattaactataaggtgaattgtgatttaactagtgagaattgtattcaagtgaactctgtttttctgaaaataaaaatataaacaatgaaaaaaaaaaaaaaaaaaaaaaaaaaaaaaaaa

SEQ ID NO: 224 - DNA, 4443 bp, Homo sapiens
tggagcgcgcaggcgcgacgtgcggctcgcagaacggcgagtagcggagcgggacccgctggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattgctcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatagtgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggttttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaaaaaaaaaaaaaaaa

SEQ ID NO: 225 - DNA, 2799 bp, Homo sapiens
ggtcaatggggacggggcgacgccactgatgctagcagctgttacggggcagctggctctggtgcagctgctggtggagaggcacgcggatgttgacaagcaggacagcgtgcatggctggacggccctcatgcaggcaacctaccatgggaataaggaaattgtgaaatatctgctaaaccaaggggccgatgtcactcttcgtgcaaaaaatggatacacggcctttgacctggtgatgctgctgaatgatcccgacacggaacttgttcgactgctggcatctgtctgcatgcaggtgaataaagacaaaggccggccgagccaccagcctcccctgccccactcgaaggtccgacagccctggagcatcccagtgctgcccgatgacaagggtggactgaagtcctggtggaaccgaatgtccaatcggttccgaaagctcaaactgatgcagacgctgccccgtgggctgtccagcaaccagcctttgcctttctctgacgagcctgagccagctctggactccacaatgagggctgccccccaggacaagacaagccgctctgcactccctgatgcggcccctgtgaccaaagacaatggtcctgggagcacaagaggagaaaaggaagacacgttattgacaaccatgcttcgaaacggagctcccctcaccagactcccgagtgacaagctgaaagcagtcatccccccattcctacccccttccagttttgagctgtggagctctgatcggtcccggacgcgtcacaacgggaaggcagaccccatgaagactgcgctgccccagagagccagcaggggccaccccgtgggcggcgggggcacagacactacacccgtcaggcctgttaaatttccaagcctccccagaagcccagcctcttctgccaattctggaaacttcaaccactcgcctcattcatcgggcggctccagtgggataggtgtgagccggcacggtggggagctgcttaaccgctcaggtggcagcatagacaatgtcttgtcccaaatcgctgcccagaggaaaaaagcagccggattattggagcagaaacccagccatcggtcaagccctgtggggccagcaccggggtccagcccgtctgagcttccagcctcccctgcaggtggcagcgctcctgttggcaagaaattggagaccagcaaaaggcctccatctggaacttccactacctccaagagcacctctccaaccctcacgccctccccctcacccaaagggcacactgcagagtcctcagtgtcttcctcgtcatcccatcggcagtccaagagcagtgggggctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatgggtccaggcagcagattctggcagcgatttctgaactgaacgcaggcaagggacgcgagagacaaattttacaggaaaccattcacaactttcactcttcctttgagagcagtgccagcaacaccagggcccctggcaacagcccctgtgcgtgatcctccttcccgcagccaccagcgtgagctctctgaatcccgggaccccttcacgtggccacagccccagccctgcccccgtcacactgctgtgccttagtcatgttgttccctttgctcgggatgcccacttcacgtcgacggcattcattggtagtacttcttgctgcaacaaacttcaacacacagagacagattcccatgtaacagtccagtgggggtgcttctgcttggcacgttggttcacacagtgatgcagggactcagctcctttcatcctgtgctctgccctccccgggagcctcagagtttgcttctggctggcggcaagggaaagggacgatggagaaggcacggctgcttcttacctgccttgctcttaactgacacacatcactcctgctcacgtcctcttggccactggtagtcatgtggccccacctggatgcagaggaggccaggatgtgcagtctccacatagtggcttcccagcaacaacttttgacttagatggggggtatgtattatggtgagaggttagccttcctggcacatcttcccttaaaacttctaacttgcccctcctagtccaagtcacctctcagatgaagtcttttttgaccccctttcagccactgggtcccttagtgctgtgtatgtgactgctgtagcattccactgcacctgctgcatacagcttacattggagatgtgtatgtcaaacgcatttttctttattgcaaagagagtctattatagaaggaaagaagtggaggcctgctgtgtggatcccttcttcttcctagctttcagtttccttatctgcaaagtggaaggtcagaccagatgatgctctggtactccacagtgctcacctgtatcactgcagggctttctgcactgaaagtggaagcagaaggctaatgggtcacattgtgtaaaggtctctggtgctcaaagtttctaggcaaagaagtgaaaatttggaattttgtctacatcctattaatgctgtgttcctcaaaagggaattggcttgtgtagtttcctaccatatcatattttattaaattagaggggccctgacttttaaaacccaaaaaaaaaaaaaaaaaaaaaaaaaaaaaaaaaaaaaaaaaaaaaaa

SEQ ID NO: 226 - DNA, 2012 bp, Homo sapiens
gttgggactccgggtggcaggcgcccgggggaatcccagctgactcgctcactgccttcgaagtccggcgccccccgggagggaactgggtggccgcaccctcccggctgcggtggctgtcgccccccaccctgcagccaggactcgatggagaatccattccaatatatggccatgtggctctttggagcaatgttccatcatgttccatgctgctgacgtcacatggagcacagaaatcaatgttagcagatagccagcccatacaagatcgtattgtattgtaggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttatactgtaatttagttattgatgtataaagcaactgttatgaaataaagaaattgcaataactggcatataatgtccatcagtaaatcttggtggtggtggcaataataaacttctactgataggtagaatggtgtgcaagcttgtccaatcacggattgcaggccacatgcggcccaggacaactttgaatgtggcccaacacaaattcataaactttcatacatctcgtttttagctcatcagctatcattagcggtagtgtatttaaagtgtggcccaagacaattcttcttattccaatgtggcccagggaaatcaaaagattggatgcccctggtatagaaaactaatagtgacagtgttcatatttcatgctttcccaaatacaggtattttattttcacattctttttgccatgtttatataataataaagaaaaaccctgttgatttgttggagccattgttatctgacagaaaataattgtttatattttttgcactacactgtctaaaattagcaagctctcttctaatggaactgtaagaaagatgaaatatttttgttttattataaatttatttcaccttaaaaaaaaaaaa

SEQ ID NO: 227 - DNA, 11242 bp, Homo sapiens
ttttttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaaggtattatatgtaggagttttcttttaatttattttgtgataaattaccagtttcaatcactgtagaaaagccccattatgaatttaaatttcaaggaaagggtgtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtggggcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcactttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgactgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgca

SEQ ID NO: 228 - DNA, 5735 bp, Homo sapiens
gcgtcccttggcttccgacatcccgtctggccgtccccctgtgccggtccgagcctctgtttatttcctttcctactatcaatactcgaccagcagaaaaggaaagtttaaaaatgccaatcgcacagttgctggaactatggaaaaagatcgaggtggagcctatggaaatagagaccacagaggaggatctcaacctggatgtggagcccaccacagaagacactgcagaagaagaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctggccccagcgtcccctgccagcatcctcgtgggctcacagaccccggcctcggagcccgtctggcacccagagtgaccacaagtccagcagggaggcggcgcccgccctcgccgtgtccgtgttttctttttcagccccggagagggtcctgacctgggggcttctccaagcctcactgcgccagcctccccgcccgctctcttttctcccaagcgaaaccaaatgcgccccttcacctcgcgtgcccgtgcgaggccgggggcttctttcagagcccgcgggtcctctcatacatggcttctgtttctgccgagagatctgttttccaattatgaagccggtcggtttggtcagactcccgacacccacgtcccaggtacccggtgggaaagtggcagtgcgagggcgcagccattggtggttgcagggccccagagggctggggtgacctggcatcccggggctccccacgggctggatgacggggttggcactgtggcgtccaggaggagatgcctggttctgcccaaaataatccaaagagccgtttcctcctcgcccttcagtttttgcctgaggtgctgggtagcccatcctttcctctgtcccagattcaaatgaggagtaagagcccagacgagaggaaggcaggctggatctttgccttgagagctccgtgtcaccaggatggaagggggtgcctctcggaggagcctgtgtccacctccagtctcggctttccccggggggccaagcgcactgggctgccgtctgtccccagctcccgtggccacacagctatctggaggctttgcagggagtcgtgggttctcgcacctgctcagccctgtgtcggcttcctgtgtgctcacctaaagctgtggttttgctgtgttcacttcgatttttctggtctgtggagaaactgtgaattggagaaatggagctctgtggcttcccacccaaaccttctcagtccagctggaggctggagggagacacaggccccacccagcagactgaggggcagaggcacaggtgggagggcagcggagatcagcgtggacaggagcgatgcactttgtagatgctgtggctttgtgttgcgttttgtgtctctgttgcacagatctgttttttcacactgatccgtattcccctgggtgtgcacacagggcgggtgtggggcatttaggccatgctgtgctctacttcattgagtaaaatcgagtgagaggttccgggcagcaggatcgacgcccagtccagccggcagagggaacacacgggtccttcattgtcctgtaagggtgttgaagatgctccctggcggcccccaagcagactagatgggaggaggcgccgctcagcccctcaccctgcatcactgaagagcggcgcctctgcagcaagcagggcttcaggaggtgcccgctggccacagccaggttttccctaagaagatgttattttgttgggttttgttccccctccatctcgattctcgtacccaactaaaaaaaaaaaaataaagaaaaaatgtgctgcgttctgaaaaataactccttagcttggtctgattgttttcagaccttaaaatataaacttgtttcacaagctttaatccatgtggattttttttttcttagagaaccacaaaacataaaaggagcaagtcggactgaatacctgtttccatagtgcccacagggtattcctcacattttctccatagaagatgctttttcccaaggctagaacgacttccaccatgatgaatttgctttttaggtcttaattatttcacttctttttagaaacttaggaagaagtggataatcctgaggtcacacaatctgtcctcccagaaatgaacaaaagtcatcaccttttctgcttgctacacaggcaacgattcccccatcagctgcccggaccctttggcctggcttggtgtgcaggcctgtctgtttgcttaaagtcagtgggttctggtgcagggagtgagaagtgggggaagtgaaagggaaagcatccgtgagaaagcggccacggttttccctccttgtgtgcccatggggcaccagctcatggtctttttcagtcatcccagtttgtacagacttagcttctgaactctaagaatgccaaagggaccgacgagactccccatcacagcgagctctgtccttacatgtatttgatgtgcatcagcggaggagaacactggcttggccctgctccgctgagtgtctgtgaaatacctctactttccctcccatatccagaacaaaatgatacttgacatccttccacaaaagtcagcctaaagaagttatggtatcatatgttaaactaagctttcaaaaaccttagtgaaatagcaagtgactgctttcaagcagcagtcgacatgtaaatgaaggtgttcttagaattcgcattttgccagctcagcgcacctccacaacgaatgaaatgctccgtatgatttgcacaaatgacatagacctccccaaaagttaactggctctccttcctcacacagttcatcataacccaaccccccacccccgggtcatgaaaatcacagaacttataaacacattgaaccctagatctcaggcttcctgacctaccgccagtggccccttgctggccaccctatagggtcctccttccctggcagccccccatgtgggagaaatacctgattctcccaatctgcagtgggagagctttgctgaattccatcccaaagtcaaacatgggcaagaggtgaggatttcacttttaccctcaagtccgatttgtctgtgattttaaactaactgtgtatgtattgatgtttggaagattgtttgaattttaaagtgataatagtacttaatgttatccagtattgttcattaaatggtgttatcctaaagctgcacttgggatttttacctaacgctttactgattctctcaagcacatggcaaagtttgatttgcactccgttcatttctgacacgttttgctgcctcctacctttctaagcgtcatgcaaattcgagaatggagaaggacgctgccggtccctgagcggtgtggagagggcggaaggtggactccagcgcagcttgaggggctgaggacggaggctgcagcatctgtgtcgttctactgagcacgcttctctgcctcgctcctgactcagcactttgttcactggctcagcagttatgtttacacatcatttttatgttcctgctttgtaattcatgtttgagatgggtggccactgtacagatatttattacgctttccagactttctgaatagatttttttgaataaacatggttttatgaagtgtaatctttttctagcctaacaat

SEQ ID NO: 229 - DNA, 4624 bp, Homo sapiens
tcggcgctcgcgggctcggcgggctgtgcgcgcccactccggctccagcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccagggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgcttattttgcatactccttgaaatgtgactcttcagaggacagggcacctgctgtgtatgtgtggccgtgcgtgtgtactcgtggctgtgtgtgtgtgatgagacactttggaagactccagggagaagtccccaggcctggagctgccgagtgcccaggtcagcgccctggactgcttgcgcacttgctcaccgagatgatgcagttggaggttgctgatctgtgcgattgctgtagcggttgccggggaccttaagagttattttgcttctctggaaggggcctatgcttgctaggcaggcagccagtgtgtctgtttttcttggtttgctgtgggaccttgcttggcgagggggaaaatctctgggtttctggagtgggagggttcgtgcagcagctgttgactggtacatgaagcattcttttatgtttgttgaagctgatgattgacatctcccgtgggtgtgccagttcttgtggagttaagacaggatttttggaagcaaggaagttagtgggtgagcttggggatgtagctcagctatctgctggtctagtggcctctaagctatagggaggggacagagccctgagctacagatgcttgagtgggttattgtgtcggtttgctagtgcagtctggtttttaagctctaaaattgaggtattttattagaagtggatttgggttgaactcttaatttgtataagggatatattttggttggggaaatagaactgagttgctaattcttattgtactcattactccatacaagaatgttatgttgaataataaaattggagaagatttcattttgtgtttccagggagtattctgtgtggggaactgtttccttacgtgaggccggcggcataagtcaaagatgagttttgtccttgcgaatcacacagattgagtctgtgttccccagggtgtgccgttacctgatttttaagtgagccagggcggacagcagcttttctgatttacagagttcttcagatttacaaatggacaatgacatcacagtttttagcactgaagccagtctcatgctagtaacagtgggtgagccgctcgagggactgggttctaatgaatactggtatgaacggggagtctctgcagtcgccagacaaatcatactcagccccttcccccgtagagcaacaagtggttcttttagagttgactggcagcatttcctgtcgggggaggtggggtttgatggagttagaaagctcgcctctgtgtacattctctcctgggctgttactttctgtagacgcacaaaatcagccccaatgtttttaagggcatcttagccaaggaagctggcttttgtgtcgccacttccaggcctgcattaagagagagcccaggcaccagggctaccactggaacctgcctcagcgtcaactgctgctggtctgtagccaggcccagcctttgagacgggtttactgtcaccagtagcctctcagtgccagccctgagctgctcctggctcagctgcccagagcctgcagcctggggaggtactcagcctctgggagacgagggccgtggactgggtggctggtagctcctgcgtttttgagctgtgtcctggctggctgctgccaatgaggtggacaccagtgtggtttggggtgcactggccacttcttgctgggttctgattttcttggaagtgcatctgccttccttatccaatagttttatccctgcattgctcttgtgaagtggctggtttggttctgtatgtagcattttgtacctttcctctggcaaaacactgtcagtttataaacattttttatatttccctcctttaaaaacagcttgtgtatttctgctataaaatgtgtcagcaaaggcagagtgacctaatagggcatgttcttaagcacagggactgtatcatgcaggggccaataaagctcaagaaaacgag

SEQ ID NO: 230 - DNA, 5675 bp, Homo sapiens
agagacgcggcaagggggcggggccaaaggccctaagctcggcgttccagagagtggggagggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagccccaggcagtgcttcctgagcagaccacccggactgtctttcctccacccgcccatggagaaagagcacgcccggccccgccctgtgctcacctctgcctggctcagcgaccttctcaggcattctgccctcctgggcccctctctccctgaaggggctttgtggcatctctggaagagcagggtgtgctgcactcatgggcctggtctcactccttggacttgtcaccttgtgacatttggcttatcagcatttgagaaggctctgctgggtctccatggtgggggtctctcaccttcttgaccctctctccatcattcagctgccagcccaggcttcacacccaagctggctcagcagccgagcctggcaccgagggtccctgcaggctccctgggcagggagagggccaaggacaattgggagggcagcaggcagcccgcagatggtggccatgtggcacgctgctgagacgacactaccaataaaccaaactgccacgcacacactgcaggctcacacccgcacacctggtcctggcttgtggagggacttgcactggaggtattgctctggcttgcctggggaagtgtcacagatgtgcacatgggccacactcagtgctgtggcctggcctgccgtagcctcacacatctgcctcaagagccagcagcaaacagctttgtggcatccttggaggttcccagtgactgagaggcctgggcagcactaaggcccctgctctgctccctggcataggccttggcctccttgcacagactctcctgacagtctggcctcctcccacctcagaggtcctctggccaccaatttatactctctccccaagctgatcctgaaggcaggcagagcagctaggggctggtaacatgtattcccatcccgtgtcctcactggtgtgtctcctggccatgggcaagggactcgggtcatcccaggccctggtccagccagacacctggccccacacctcccaccaggctgctgttgctcagaaggagaatactgcagctgtatgcatccccgtgtgtcttgggcccagctcgctgggtcagtctgctcctgtcccctccagcatgcactgcctaggtcagcacaggttcctgatccatggtgtagttagcccttcccacctggcaggacggcccagaccaccagccaagcagggaaagggggctgggcttgacgggagaagagaccagcgacatggtcgttggggagcattcaggatggcgacttcagctgggggtcatgctgagcaccaacaggaactattccagtgaagagcaagtgctgcccgacccaggaccctgtgccaggctagcagccctccagctccctccagagaggaaacctctgtctggctgagggtgggactagctgggatgtctcactccagttgctcaggttcacccaggaagctcctccgtggagtggccagcctgattctagccctgtcctctctggcagcacatgccacacctgcctgggccttctgctccctgatgcttgatgagcccctgcctcctcaatgtttctcaaagacagacccccctgaggccagcttgaatgtgaagactgctgaagttagctggcttcacttgagctgcagaaaaggtggctgggatggcccaggtgcacccagaggccccagccctttggctgcctttgggttgtgacttgggttgtctctgaggccctgccagagctgggcctgcgggtggtgggcggtccgacctcgggcagtcagtgctccgcagcctcagcactgcatcccagacccagtgtcctcagagggaagagccagcctccctgcctcatggaaccaggagtcccaaaaagtcaggagcctggaggctctgaaaggagcagggattccatagtgcgtgaagctgaaataggcgccctcctggggagcccccagcaaaactgtttttcatacccactcccagaactgccccgctccagctccagcgccagcgccagctggttgccaggcatcattggagaggcctggctgccccaggggcagcagggagtggtggacctgtatgggctggcaggaggccattggccatgctgacaagtgtcacctgccttcctagcctggagccacccctcaggtggcctgcttgcacctcctatccggaggtagcctgccccacctgtaggcagagggggctcttgcttgaggcctgcacaggaagcaagtatagccccggtgccccagagtgggttccacttagccctggcgagatggcctgtcctgagatctctgctcccagaccccaccatctggggagcacagtccttaggctgcctggtccaggaagggggtgcggctctgtcaggaaacctggactctcaaggcccaccagcctctccgtgagtgttagaaatcacagatacagtatatacttaattacactaaattattgctgggattccttataagcactaattatacctgattataggttaaaatatttattttgtcaaaatattttcttgggaatgtgtttaaccctttctgcgttcattgttgctgagatgtgaaaactaaccattccctcctgcctacctttttggccactgggcggcagagaatggcgctatgtgcagttgggcccctggcaccatgggcctttggcctgcctgctgcagagtagccctgcctgggcagtctccaggcactgagcaggccatctgtggccaggctgagagaatgactggctcgcttaccagcgtgcatgggacaaggagctttggagcctcaaggggttgttgctggcctgggctagagggaaaggtgaccatccgtctgtcctcctgtctttctattagcgcctccatgtgagtgatggtgccttggttcactagccttcccccaccaccccaccatgccacctggtggtcttggggcctgtgctgtcactccagcccctggggaggagaggacccagcccggagagttggggcaagggctccacatggcccaagggcaacagatgctcgcagggcagctgctgccgatgctcacgctcctgcccccctccttcccgctgccacaccccaccctgggcccccgcagacacgcatctctaactcagttgggcccagccttctggatggcttggggtaggccatgggcccacctggggccaggccagcccctggggcagctctggaagagcagtgtggaggagcacttgcttgcagcctggcttcagcctctggcactgctggagtggtccctgggagcttctgcactgtcggctttggggacgtctcacccacttgggttacagtaggccttccccacccagagagaagtgtttccaccccagagacattgtctgtcagcccctgaagtgctcgcctcccccagtgcccgtcaccagcccttcctatctgtggggtccaagtcaggcttcccctgcggccaccagccatagggagcagccatcagcccccgagtcagaactgcttctgtctgtccatacctccaggctctcccggagagggggacggatatttatttcctaaagtttgcacttaattgtgaggattctcaggattgttgggggctactgaaaagaggaatgtgttgaatgtcgcgtttgctgtccactcgtcctagaagtttagtgtttttgtcactgtcatgtgtttctgtgggcagagctggttctggagggtgggtcagtgcacccgaggctcagagcatccatccaccccactggccctccttccagataccctctctctaattgggttcttgcatgtaaaatactccacaataaataaataattgaacaaattaaaaaaaaaaaaaaaaaa

SEQ ID NO: 231 - DNA, 5872 bp, Homo sapiens
aaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagccaccctgtattccaaatgggaaagaaaacttctcaggaggcacctctttgtggcaaaacatctaaggcctgaaaaccattcacatatgggtcttctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggtttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagcaaaacaatggtctcttctgggaaaatgttgctgagaacaatatagttaacaactaagactcctaaaagcttctctaaactgtaccctccaatccagccttcacatggctgctttttttttttttttttaatacgaacctgtccttgtaacactttgatgttatcatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttgctcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaa

SEQ ID NO: 232 - DNA, 2783 bp, Homo sapiens
ggaggaagcgcggaatcaggaactggccggggtccgcaccgggcctgagtcggtccgaggccgtcccaggagcagctgcccgtgcggaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagtcctgggctgagatcaccagccaaactgagggcctgagccgcttgctgcggcagcacgcagaggatctgaactcagggcccctgagcaagctgagcctgctcatccgggaacggcagcagcttcgcaagacctacagcgagcagtggcagcagctgcagcaggagctcaccaagacccacagccaggacattgagaagctgaagagccagtaccgagctctggcacgggacagtgcccaagccaagcgcaagtaccaggaggccagcaaagacaaggaccgtgacaaggctaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgctccctccaccgctgcagctcattccggaggtgcagaagcccctgcatgagcagctgtggtaccacggggccatcccgagggcagaggtggctgagctgctggtgcactctggggacttcctggtgcgggagagccagggcaagcaggagtacgtgctgtcggtgctgtgggatggtctgccccggcacttcatcatccagtccttggataacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgaggatcctgaagcagtacagccaccccaacatcgtgcgtctcattggtgtctgcacccagaagcagcccatctacatcgtcatggagcttgtgcaggggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacggccgctactcctccgaaagcgacgtgtggagctttggcatcttgctctgggagaccttcagcctgggggcctccccctatcccaacctcagcaatcagcagacacgggagtttgtggagaaggggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgaggctgggacccccttctcaagctggtggcctctgcaggcctaggtgcagctcctcagcggctccagctcatatgctgacagctcttcacagtcctggactcctgccaccagcatccacactgccggcaggatgcagcgccgtgtcctctctgtgtccctgctgctgccagggcttcctcttccgggcagaaacaataaaaccacttgtgcccactgaa

SEQ ID NO: 233 - DNA, 661 bp, Homo sapiens
ggagtggcagccggagtctgaactgtcctgggggaccaagcaggagcttaagatgggcaagacctggggccctgggcagacgcatcaaagcaggcagaagcaggcatggccagcaggaagaccaagaagaaggaagggggtgccctccgggcccagagagcctcatccaatgtcttctccaactttgagcagactcagatccaggagttcaaggaggcattcacactcatggatcagaaccgagatggcttcattgacaaggaggacctgaaggacacctatgcctccctgggcaagaccaacgtcaaggacgacgagctggacgccatgctcaaagaggcctcggggcccatcaacttcaccatgtttctgaacctgtttggggagaagctgagcggtaccgacgccgaggagaccattcttaacgccttcaagatgctggacccggacgggaaagggaaaatcaacaaggagtacatcaagcgtctgctgatgtcccaggctgacaagatgacggcggaagaggtggaccagatgttccagttcgcctccatcgatgtggcgggcaacctggactacaaggcgctcagctacgtgatcacccacggggaggagaaggaggagtgagacccagccgggtcaataaacctggacgcttgga

SEQ ID NO: 234 - DNA, 2058 bp, Homo sapiens
gggtccttcaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttgatatgtgtcacttttttatgctgaaagtatgctctgaactttagagtataggaaattaactattagaatttaaagaatttcttgaatttctgtagtttgaaaatacgactttaagctgctttagtaaaacacttccattttgtgtatagactgttggtaacttcactagagcatacataacaactggaactggaaattatacaaaagtaaattgggaaggatactccagcatctgacactggcaaaatggaaacctttgagtttctcttactggctgttgaagtgtgtgcagtttttaacaatggtttttacttggcatctctttgttgtgattttcaaggttataagttgctttggtcctaggattgaagttgaaatctgagtttatcagtgctaaccatggtgctagtagtcaagagatcttgagaattttggctgctgagtcttggtgcagggtgcaggttttcttttcttttttcttttttttttttttgagatagtctctgtcacccaggctggagtgcagtggtacaaacatggatcactgcagcctctacctcccgggcttaagtgatcctcctgcctcagcccctaagtagccgggactacaggtatgtgccaccatgcccagttaatttttgtaattttttttagagacagggttttgccatgttgcccaggctggtctcaaactcttgagctcaagcgatccattctcctcagcctcccagggtgctgggattacaggcgtgagccattgcgcttagccatggtgcaggttttcaaaggccaggaagtatattcataattttaagatggggaatatagcaagttttcacataggtgtgtgtaagtcatcacatcatagaaacttgaggaattcagtgacattaattttggattttcatacgtaagtatacaattaaatgtttacagggtagtagaagcacattttaaatgtcaggaactgaactaagtatttgaattacgtggattatctcaaaaattttgaaattgttaaacgagttgaattacttgaattcattctgttagtcaaatggtggatatttacacccatgtagttttgaatttagagtgtgtagagtgttttcagttaccagactccatgcttttacctcctatgtgtcaggtataatttgaacctctaagaacagggtttctcaaccttgccactgttgactatttctgaaagacagtttggtttagcagaccatcccatgcgctttagcttgtttagtagctaacttgggctctgccactacagacaaaaagcactctttccctccaattcccacaggctatgagaagaatggagacattaccaaatgtccattggtgggcaaaattgcttcattcctacctctgttgagaattactctagatcctttggcacaaattacctcaaagtttaaaattgtgtaaacaaacagtgtgtcatgtaattgaaaaacattaagcaactccaaataaatgctacattaag

SEQ ID NO: 235 - DNA, 3226 bp, Homo sapiens
aggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaaaaaaaaaaaaa

SEQ ID NO: 236 - DNA, 1297 bp, Homo sapiens
cgcagctggagcctgcggctgaggctcgggcgcgctcaggcccggatcctggcggcctgggcggccgcaccatggactcgggaaccgaggagtacgagctcaacggcggcctgcctccgggcacacccggctccccggacgcctcgccggcccgctggggctggaggcacgggcccatcaacgtgaaccattacgccagcaagaagagcgcagccgagagcatgctggacatcgcgctgctgatggccaacgcgtcccagctgaaggccgtcgtggaacagggccccagcttcgccttctatgtgcccctggtggtcctcatctccatctcccttgtgctgcagatcggcgtgggggtgctgctcatcttccttgtcaagtacgaccttaacaacccggccaagcacgccaagctggacttcctcaacaacctggccacgggcctggtgttcatcatcgtggtagtcaacatcttcatcacggccttcggggtccagaagcccttgatggacatggcaccccagcagtaggacacccaggaccctggatgctgcctgccctgcaactcagctgcccgaccccaggagtcgccatacctgtgaggtgtccacctccctgcacatggcactacccagactgccagagcccaggctggcctcatctgcaccatgtccccggaccagcccttgctctgactgcggccaagcaccacgcaggaggccactcttgtctctcagcagctgttcccaggaggcagctccctcctggcacatgggggctggccacaatagcccagagggtcagaactggacagctgcagagacctgtgcccagagaagggtctcgacccactcaaggacacacagcaggtccgtggatgggctggatgagtgaccagggccagcctctgtctcaggacattccagaaggacaaggagatgtctctccctctcccaaagcaccagcgtccctgcctcccgtgggccctgtccgggttgccctggtgaccccagcctctgtccacttcctaacccagggaccctgcacagccagaactgcctttggccctacggatggccactggctctggtcttaagtgcctgggcttggtggccatcaagagggagccagtcaggcctgtgagggccgtagaccttgtatataccctgcaccagcagtgaccgggcagagcccaaccccctccacgggggtcccagcacccacttttctaatcatgaatgaacaataaagcccacgctctttgtcaggctccacatgccaaaaaaaaaaaaaaaaa

SEQ ID NO: 237 - DNA, 3631 bp, Homo sapiens
gcggccgctgcagagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccggacttatgaaaatatgcatcagtttaatactgtcttggaattcatgagatggaagcataggtcaaagctgtttggagaaaatcagaagtacagttttatctagccacatcttggaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagacattcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatattttatagaaaaaaaaaaaaaaaa

SEQ ID NO: 238 - DNA, 2964 bp, Homo sapiens
gtttcccggcaggcctcgcgtcaagacggccggcgggacgggagctgcggcgctggctacgagagtgacccagtcagcgttggttcccgtcttggccatggcctcgttcgtgacagaagttttggcacactccgggaggctggaaaaggaggatctggggacccggatcagccgcctgacccggcgggtggaggagatcaagggtgaggtgtgcaatatgattagcaagaagtacagtgaattcctgcctagcatgcagagcgcgcagggcctgattacccaggtggataagctatctgaagacattgacctgctgaaatccaggatagagagtgaggtccgccgggatcttcacgtatcaaccggtgaatttacagacttaaagcagcagttggaaagagactcagttgtcctaagtttgcttaaacagttgcaggagttttccactgctattgaagaatataattgtgcattaacagagaagaagtatgtcactggtgctcagcgtctggaagaggcacagaaatgcttgaagttattaaaatccagaaaatgctttgatttaaaaatattgaaatctctcagcatggagctcacaatacagaaacagaacatactttatcaccttggagaagagtggcagaagctgattgtatggaagttcccaccatcaaaagataccagcagtttggaatcttacctacaaactgaacttcatttatacactgaacaatcgcacaaagaggagaagacccctatgccacccatcagttctgtcctcttggcattttctgttcttggagaactacacagcaagcttaaatcatttggtcagatgctgctgaagtatatccttaggccgctggcatcttgcccatcccttcatgctgtgatagaaagccagcctaacatagttattattcgttttgaatctataatgactaacttggaatatccatcaccatctgaagtttttacaaagatcagactggtactagaagtgctccagaaacagcttctagatttgccacttgacactgacctggaaaatgaaaaaacatctactgtcccattggctgagatgcttggagacatgatctgggaggacttgtctgagtgcctcatcaaaaactgtttggtttattcgattccaacaaatagcagcaaattacagcaatatgaagagatcatacagtccactgaagaatttgaaaatgccctaaaggaaatgagatttttaaaaggagatactacagatttgctgaaatacgctcgtaacatcaattctcattttgcaaacaaaaagtgccaggatgtgattgtggcagccagaaatctaatgacctcagaaattcataacactgtgaagattattcctgattctaagataaatgtgccagagttacccactcctgatgaggataacaaactggaagtacagaaagtatccaatactcagtaccacgaagtgatgaatttagagcctgaaaatacattggaccaacattccttttccttgcccacatgccgtatcagtgagtctgtgaagaaattaatggaactcgcctatcagactttactagaggcaacaaccagtagtgatcaatgtgctgttcaacttttctactcagtgaggaatatcttccatttgttccatgatgttgtaccaacatatcacaaggagaaccttcaaaaacttccccagttggctgctattcatcacaacaactgtatgtacattgctcaccacttgctgaccctcgggcatcagttcagattgcgtcttgcccccattctttgtgatggcactgctacttttgtggatcttgtacctggcttcaggagacttgggacagaatgctttttggcccaaatgcgggcacagaaaggtgaacttctggaaagattatcaagtgctaggaacttttcaaatatggacgatgaagagaattattctgcagcaagtaaagcagtccggcaggtactgcaccaactaaagagacttggaattgtgtggcaggatgtcctgccagtgaatatatattgcaaggctatggggactttactcaatacagcaatttctgaggtcattggcaaaattactgccctagaggacatatctactgaagatggtgataggttatattccttatgcaaaacagtgatggatgaaggaccccaagtatttgcacctttatctgaagaaagcaagaacaagaaatatcaagaagaggttccagtctatgtgccaaaatggatgccattcaaggaattgatgatgatgctacaagccagcttgcaagaaattggggatcggtgggcagatggaaaaggacccctggcagctgcgttctcttccagtgaagtaaaagctttaattcgtgccttgtttcagaacacagaaagaagagcagctgcccttgctaaaattaaatagctccatcttcttaagaaagctatgtcttgaatatgtggattcttcccttggcataattactcccttaaagacttctttgaatcgcccattggttttggtgaaccagtacatcttggaagtttgactttacagaagaacgtcttacctcctggcctgtacgaggctttgtttaagaactgtttattaagataaattgtcaagtaaagcacctcaattcattgactttctagccatcttcctttgattagctaacaaactgtcaggcagcattatttcatgctgcttccagagccctctgggagctatatacattgtaaatgcaggccctagctttggaacgaggaattgggagattccaggagtcagggtagagaatttctgagcaaatcggagatattttaggggtgtggaggaggggaagggaggaatgggccaccatatttggccttacaggaattaaggagacttcctgtaatatttctttccaataaatattgctttttacaattaaaaaaaaaaaaaaaaaa

SEQ ID NO: 239 - DNA, 11957 bp, Homo sapiens
ctctttacacagaacagtttaacttttgtgcttctgggcagaggtatggtccttgggacagttctccttccacctaatagttatggcagagatcaggacacttcactttgctgcctgtgcactgaggcctcagaatctgctctacccgacttaacagatcactttgccagctgtgtggaggatggatttgagggagacaagactggaggcagtagtccagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacgggtaacttctcatctgttgcttctctacagcatgctgatgggttctctttcactcctgcccagcaagaggcgaatctggtgccacccaagtgctatggggggagctttgcacagaggaacctctgtaatgacgacggtggtgggggtgggggcagtggcactgctgggggtgggtggtctggcatcacaggcttctttacaccacgcttaatcaaaaagacactgggcttacgagcaggtaaacccacagccagtgatgacacttccaagccttttccaaggtcaaactctacatcttccatgtcctcagggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtagccactgttagcctggtgggaaaatgcacacatttctgaggggagagggaaaaggacttgttttcctgtgttcttgttttcagaaaatgaaagactcatacttgagtgtgtttatgtgaagtacctcagatccctgagttctcacgtttacagtttcatctcaaaaataagaagcaaaccacataagtataggagaggtaaattaagtgggggcaaggcagtagtggacagggttggaaactgcactggaaaatagggaacatgtgtatgtcataaggaaggcaatgcagcccatccctacctggaatgctgggaagtgctaggcagggctgctctcagcaagactgcagcagctgcacccagacctggggctctggtaggtactaatggtgattatgctccaatttacctaatgaatttggtgggacagcagaaaagaaagctgggaatgtaccaagagaaatttttgttcagggctgttggaagtagctgttagccttgcttccacaaggccattgctgctgtaataagaactgcaaatcagagtgctacaacataaaactgggaaatatggccctatctgaatgcctctgtcctattttccgctggtgtatcagttagtgcaggaagtaaagaatgctggaaagttgaatcagaaattgaaaaccttctaaaatcttacacagattagcagaagtcacttctcccagtctggtatattatttcataatggaccaggatcggcttcctgcctgttggtggctatctgtaaaccataagtacaggggtctccctagtggttcttctctgtcttttgctgggcaggctgtcttcctttattcctggtagcattcagagcattaaccagtgttgattttgaaaatagtagtccctacaggttctcacaaaggaatgaatcctgttctgatacagttcccctgcatactgacatactggccaaggacttgagcagctgtgtatttttctttatcaactaaaataccagggagatggtcttttcttgaaacccagtggcctgtatgtgactgagaggaaaagctggcttggtcctaatggctgtttctctgtacctttcccttcccttaccaccttaagcccaatccaggtagagaatagggagaggcattctcctctctatggatttgaagtgaatcacccccacattattctcacatgcttttcttctctcacatattcctccctactcccccacccaatcattgtgcttatttgtacagatcttattgggaatattctttatttattttgtcatttcacttctattttaagaatgcataattgaaggagtagtcattttcagggagcaccaggtagaccctgggaacctaatgacttaatccttaaatatgttttgcccttgaaaaataggccttttccttccttccttagttataattgtggaagctaattaggatggcatggaagtgaatctaatgagttaggtattattaatgttcttggtatcgggtctaattccagttactgcttcattctctttttaaagctttatgaatacttcccccatcctccccaaggagagctcaatacacacatatttttattttattctctcaaaggaatattagcttaggaagataggaattcaacattgagcactgagttttcttctggctctgtcattgatacactgtcaaaccacagcctcatctcttaatctatttaattaaggtaacagtacatgttctcaagggtgttgcaagtaagtgtgcagctatcccttggagagcctctctggaaagctcttttagtgcagtgttgttatgctgaattgttttccattatcttatttgctgagtagaaaatattaatgaaattaagaattgttgagattatatgaattgggctagaatactaaggggaaaactatgttttgaatagagtttggcatttttgaccaagaacaaaattgagttttcattggaaagaaaggaaaccttgattcttaccattgctgctccaaaggaggcccaggttaagaggattagaggagacacgcggtgctgggcattcctggcaggtgttgggtgatccccgcagtatgtcacctgcagttgcagcacaggcagctagtgattgggttcatctcctcctagtggttggaagagaactcagatgtaaaaaccagcggtccttctcccaccttctttcctgccattcttgctcatcatacatgtccgtaaacttgaagaactcgttttagcagctagccttttaaggtcgaggatgggaaagctaaaactgtagaatattattatgctgctttttaggtttatccctgttgttgtgggatgcaagttaagggattgtaattgtttttcagggtttttttgttttttgttttttaagcaagggctctattttcccttgagagttctggaactaagccttggagaaacactactgagtgtatttaggctccctggttttcttgcccaacaacaatctgaagggtagggggtgggggctgtgtcttactcaggggcagcacctagctgtcttgcctacagtgggtgcacgatatataaatggaattgatttttgtcaacactgtcaagagtggcattgactattggagcataccccgtccacatgatgcttgaactatgtaacttcaggggttgagggctcaaggttcaggttaaagaggcactgtcaacttactatacaagcataatttaggtttttcctttttctacttgaaaaggaccagcttaaacacaaacccttatgtaaattaaaaggtttgaatccaaagcagagagaactgcttctggaaaagtgtagtttaattttaactattctaaaagcaatgagcaaaggcccttgtccaaggcgttgacagttttctaaagtggttatgctgtatatctggatgcatgcctttgggctgccactgcttgattcctttcatgtacagataatattacttcagtttagatttcccactttaaaatgcagtgatttgtgttgaatacatcttgattgtgctttacctaaagtattttcttaaaaggctttgtgtaaaatttaaatgtatatattttcctgtagacttccatcatgattttcagagattagccttaaaaaatttggccctaagaaattcattcagtgtttttctagatgacctctgtacatagaggtcattatagtggagaccctttaccagcagcattttaagatttaaattagatagaaagtttcttaggattcaactgaaaattggctagtaaaatatgtcccaggtaataaagcatgctgactttgctaaggcactgcccatttttatttaactaaagtcatggagattttgagtttaaaggatgcagtatagatagtggtttagtgtttaggctctaatgccagtctaaaaggcaagtcatttaaccttgggagcctcagtttcctcactgtaaaacagggataataatagtaactacctcagggttgttgtaaggattaaatgagatgatatttgtaagatacttagctcaagtgcctggcacacaatgagcacactctataaatgttctactactactattattaacacctagtctagggatgcacagcagaatcccctagggttaaaaaacaaaacaaaacaaacaaaaaaaactgacggaatagccccactccagatcagaattcccagtgggctggggtctcggccagtgtattctccagtaatctcgccaggtgtttgaaacacccagtgctatctgaaaactatcagtaccccaaccctttggtttatagattaagaaactagcagaagatggttaaattacttgcctattgtctcagaacggttaattagtggcggagccaaggctagaattcaagtctcttgactttatggttgtggggtctttccaccatacctgctgccatgtgagacactgcaaaaaagtggctcagaccgacaatcagcctgtgtggtgctgcacactttctaaagcacatgctcctgacactttgaccttaaggggcttgaatgtggagtaatgggaacacaagccaagcaagcactcagtagaattcagtcatttaaaaaattcaatggggtcattcttttggacagacctcagcaacacagcaatgtgcactttgtagtaaagaaataccaacttgagtttttaaaaaacctagttagtcctacattcccttttctttaaaaaaactttattgttcacattattttaatgactatgagataatgtatatgacagcactttgagaaaatatcaactgtaatataactataaggttgtagtattgtctgtttaaaagataagacagttgattcaatgtggatggaccctgtggggtacctgaaaatgtagatacgtaagaatcacctctgtcatttatcacatttagaaatatgaaactgcttaacaggtatgagcaggtatagcaagtgtttgctaaagttgtagttcagagctgaattacttcaggaaactagggaccaactttttggtttaattccgatctttaaaaagtaagaatgtgtactcactccagaacacagaagctcttccaaggaccttgactcaagaaggatgaggtcctcttactcttctccatttatccactatatgcttggccatttatcctaaatgtggtgggaacagacttgttatctgttgatgttgacagtgtcttttttaacctatgtcctgcatagttttgttaggtttacagggggaggtggatggccataaaaccagtgcactttgggaattacttttctaggatttcctaccagttataaatgacattgacatttgtcatcttttttttctttttctaaaaagaatagctgaatttaattcacctattataaaatactcaaaagtaaattgccttggtggccacttctgaattatagctacatttcattatgaccccttctgctcccttccattttgctactgatgtcattcttgttatcaggctgtgcccctaccaggagttcatattgggttgacagggttatctatatttttgttcttgatttttgagtttcatcatcttgcattaaattgttccacctggatttggggttcatctctgtgccctaaggatctgctatgaccaatcctctttttgtaggtgggtctctggcttaagtattgataggcttcagcggtttgtgtctctgtcttagcttgtatcaagccagtagtagctcacttcctttgtaaattcctgcttcagtctgggatccgtaggagtatgtgagaacttctgaaacgtctccaactcttaacagtcaagatatctatatcatttggatagagttctggttttccaactactagacttaaagaaattctggccgggtgcggtggctcacgcctgtaatcccagcactttggggggctgaggcgggtggatcacgaggtcaggagattgagaccatcctggctaacacggtgaaaccccacctctactaaaaatacaaaaacttagctgggcgtggtggcgggcgcctgtagtcccagctactggggaggctgaggcaggagaatggcgtgaacccaggaggcggagcttgcagtgagcccagatcgcgccactgcactccagcctgggtgacagtgagactccgtctcaaaaaaaaaaaaaaaaaaaaaaaaaaaaaaaaaaagaaattctaatgcaaagcttgctttttttttcttttttccagcaagccagtagtaatagttattgttacttgctctgttcagcacaactgtagttcacttgaacttcactgtcattccctacgctcctctcttactgagaagcatgggtgggattcagggctgtgggacaagctacagcctactctggagcactcacccccatgactcagtccagcctgtctcttgggaagtttattgcaatgtgcagacggatgaatttctgcttttcatgccacctctctgaggtatgtattctatcttgagtatgtacaagatgataccttttggctgggcacagtggctcgtgcctgtaatcccagcactttgggagaccaagatgggcggatcacttgaggtcaggagtttgagaccagcctggccaacatggtgaaaccccgtctctactaaaaatataaaaattagccgggcgtagtacatgcctgtaatcccagctactcccgaggctgaggcagaattgcttgaacccaggaggcggaggttgcagtgagctgagatcgcgccgctgcactccagcctaagtgacagagtgagacacgttaagaagaaaaaaaaaaaaaaggataccttcatttctgactcaatatcctagatccaaaggacaggaaattagggaaggcttcaccctgtgggatcaagataagaagatcccatacttcttcccaggtaaggaggcctgtggcaggtcatgattcaaagctgacttggaatggcagaaactgctgagaggccacccttggagatttgtgccttcaaagatgggtttcatgagtctcagagaggaaaagacttgtcagctgggttgattttgcatgattattgaactagagctggtagacacgagcttctcagatggcagtggccagatcctccatctgtgagaatccgccacttgaagtggtttcctgagagtgttcacttggcagttgctgcgtttctcaagcccacctggcgaggtctcgccggacccttccctccaagtgcacttacttcttcatccccatgtacatctctaactttgaaattgtttacctctcctacaaaaatcttaccttttgacctgagcagagtagcaaagccctgttcactctgagggagcagctggcgtgttgaaggggaaaggccaggcacagcactgtcctcagaccacaccatatttggagcagaattgtgatacatgtcatctgtgtctattctggaaggttctttgttcatcactgtactcgcatcagcaaattttcagggtcctacctgtcactccaggctactgagctgaaccctcagaagctgaggtctccgagcatgctaagtaaccttttagaaaagctggaggcaaactgtcgaatgctagcaggctttatgaaaggaaacataaggagtttgtgtagtcagaacttgcttaaatttgcttcggaattaggcaccataaactttagttggagaatgggacttaaattttcacatatatgtatacttaattttcagcaattatgacacaataaaaagaatatgcaaatttattgttgtttcagaaggttttgcaggactgggaacgctttagtgtcatcaacagtaaacctcagatactgttctgcacagttcagaagtaccataccaggtattgtgagtggcaagaacgccaggggacagagatgcttctggtagatgagggccagagaaaccagctctcctccattttgacagcaatttctcactgtggccatttggcctccattatgttttgagaggaatttcttgagatcttgagaaatcaccatgattaggccaattgtcaatcagtattcagaaactagaaaggaacaatgagatacttgtttatggttctttagggcatatgtttgaaaaccctctcatctcagatctgtatagctggtgtgtgtttgtgtccataaatacacgtgcattgctgtcgtgcccattaagaaagggggagtaagtaaaagaggaatcgctcagatctttccttggatgaacagcagtggcgtggttggtgtgttgactgtgaacaggctgacttagctgttgatgtatactcagaacctccatctcctcccagaccctgcacttttccttctctgcagtctgattctctaatgactgtcactggacaaaccccagttttatgctcgcttagtaaaaataagtttaaacatttcatggtggttgacagaactttgtccccaaacatgcggattcaattctttaaaactcgttgaacgtttataccaaaggtcccgccccgcaggtgtgtatgtggtgcacagagggtgaggtttggagcatcgggcactgtgtgcattgctaaggggacatagtgagacaatgtgggatttaactaaaaacacatcaattgtgtgtcacattaccagtgttgtcaggtatttgttcttaattgttattgtaatatattttcagttgtttttctaatttaattctctccgtctgttgtctgactgtgaactgctaacagtgttaaacttgatgtaaataaatgaggcccttgaaagggactgctttctctgtcttctcacaaggtttgccaagttgtgttctgttttaaataaaggttgcaatattttattggcaaagtaaaaaaaaaaaaaaaaaa

SEQ ID NO: 240 - DNA, 5837 bp, Homo sapiens
cccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctgctccatcacctgtcctgacgattaagaaagatcggacctccagaaatagcatctctttgtcctggcaagaacctgaacatcctaatgggatcatattggactacgaggtcaaatactatgaaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactctttctccatctctggtgaaagtagccaagtggtcatgatcgccatttcagcggcagtagcaattattctcctcactgttgtcatctatgttttgattgggaggttctgtggctataagtcaaaacatggggcagatgaaaaaagacttcattttggcaatgggcatttaaaacttccaggtctcaggacttatgttgacccacatacatatgaagaccctacccaagctgttcatgagtttgccaaggaattggatgccaccaacatatccattgataaagttgttggagcaggtgaatttggagaggtgtgcagtggtcgcttaaaacttccttcaaaaaaagagatttcagtggccattaagaccctgaaagttggctacacagaaaagcagaggagagacttcctgggagaagcaagcattatgggacagtttgaccaccccaatatcattcgactggaaggagttgttaccaaaagtaagccagttatgattgtcacagaatacatggagaatggttccttggatagtttcctacgtaaacacgatgcccagtttactgtcattcagctagtggggatgcttcgagggatagcatctggcatgaagtacctgtcagacatgggctatgttcaccgagacctcgctgctcggaacatcttgatcaacagtaacttggtgtgtaaggtttctgatttcggactttcgcgtgtcctggaggatgacccagaagctgcttatacaacaagaggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaattaaagctgtagatgagggctatcgactgccaccccccatggactgcccagctgccttgtatcagctgatgctggactgctggcagaaagacaggaacaacagacccaagtttgagcagattgttagtattctggacaagcttatccggaatcccggcagcctgaagatcatcaccagtgcagccgcaaggccatcaaaccttcttctggaccaaagcaatgtggatatcactaccttccgcacaacaggtgactggcttaatggtgtctggacagcacactgcaaggaaatcttcacgggtgtggagtacagttcttgtgacacaatagccaagatttccacagatgacatgaaaaaggttggtgtcaccgtggttgggccacagaagaagatcatcagtagcattaaagctctagaaacgcaatcaaagaatggcccagttcccgtgtaaagcacgggacggaagtgcttctggacggaagtggtggctgtggaaggcgtagcatcatcctgcagacagacaataattctggagatactggtggaagttccaagtccaataagacactcaaatatgagtacaaatgccttaaaatggaattgaaaaactctttattttcccctatcatttattggatgggtgggtggggtatttttttgtaattgcttttttaaatattagttaatggattaaatttaattcttcagcgtaaaatggtgaagaactagcatatagccattgatcataaactgactatcataaaatcaaaacaagtgaaataacaaaatggacatggtggctttgtttaggtagagccacaaaagaaaagacttgtaatatttttatatacagaggaaatctgtaacaggtattttgtttcttttaaagcaagcaacacagaggaatttatacctcaaactatctggccatatttactaccttatcactgcattattctcttttatctgtttaaagcatatagagatgaagtttgtagttgttttaagtactacacatttttaaattgttagcttccttaagtatatcatgtaaagaaatgtcttaatttttgaaaaaagtacatatttattttcttttgaattgtttttattgttttctatttatgccttgatgatttaatatggatttgttacagccaagtgccaaatgctctctcaaattgtcagcaatttaactagacacagataataatgggtttctttcagattttttgaaccatccacttacatatatttttaaaaaatgaaatccttttcctgttcatacactaaccaaatctctcaaatctgttatcccaatcattgttgcctctccgtttattataaactgtatgctcacaacttagtgtaatataccagcttgtatgcaatggattttcaaccagataacatacctttcctgctctggtgcttagagactatcaactccctcctttagtgaaggagccgtgttagagcttccgagaatagctccactggagagaagtggaatcctatatagaatgctgcactaattgacaacacagcctataggccaatgcatgagtaaaaaaaaaaacaattactggctcactggctttgaaaagtcacttactattgttgctgaaacttgctgagctgtttatagagaatgatgataacagaacttttcctctgtatcactggtgtttaggtgaattaattaaacattgtgatcattagtaccaggtattattatctttaagagtcttccacttcaatgcacatggtgcagttttggtgtgtaacttagaaggattgaacttctttgaatttactggacataacattttcagaatagttggtcatctagcaaccgcctcaaaatgtgtaagcaggagagaaatttctcatcacagggatttagacttactattacataaaggctaactatgagcttgctcattaattttgaaaagatgtacctggtggatatctagctagtaatatattctgaagcaacattttagctctattgatactctttctaatgctgatatgatcttgagtataagaaatgcatatgtcactagaatggataaaataatgctgcaaacttaatgttcttatgcaaaatggaacgctaatgaaacacagcttacaatcgcaaatcaaaactcacaagtgctcatctgttgtagatttagtgtaataagacttagattgtgctccttcggatatgattgtttctcaaatcttggcaatattccttagtcaaatcaggctactagaattctgtattggatatataagagcatgaaatttttaaaaatacacttgtgattataaaattaatcacaaatttcacttatacctgctatcagcagctagaaaacattttttttttaaatcaagtattttgtgtttggaatgttagaatgagatctgaatgtggtttcaatctaattttttcccagactactattttcttttttaggtactattctgagcatactcaacaaaacccatgcatttcataaactaatagaagttgaggattgttgaatctatttcacttattttggctgtggtttccatctgaaagtagaggttgtatacaccatatactgttcttcattttattaatatttttctccttgacctctcataaatttactttacacaattcttaccctgtacatatgtaaacataagtgtacgattcttaaccatggagtagaggtactagaatgcttacggccatctctttgtacaggaactgcattgactttcagtaaacataaagccacaactcctacatgatgttatgtaccatatgatctgttttgtatcttaaatttgatttacatatattatttatttctggtaactcactcagtttatgctgtgctaaatatcaatcaagccatgtataaatgtgatatgattggcaatatgtgtttactttaaacttgtcttttcaaaatattactcagtttatgttgtacaatgtagatggcctcttactaatgtaaaatgatttgtagtggaaacatttatatttttataataaacataatgaaaatattttttacagattggaaaaaaaaaaaaaaaaaaaaaaaaaaaaaa

SEQ ID NO: 241 - DNA, 2472 bp, Homo sapiens
gaagagaccatatttgttcgcagaggaagccgttgctttctgggatctggctacgccagaaaagacatcggctccaacaggggtgttccacagggtagctgggagttggaagagccaagaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaagctcaactataaggactgtgagaaggcagtgaagaagtaccacatcgatggggctcgcttcttgaacctgacagaaaatgacatccagaagttccccaagctccgggtgccgattctcagtaagttaagtcaggaaatcaacaagaacgaagagaggaggagcatcttcacacgcaaaccccaagtcccgcggtttcctgaagagacagaaagccacgaagaggacaatgggggctggtcgtcctttgaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccataatttatttattcttcttcaatgtttgtaaagtgcatgagtcatgttcacacttgaagtctagtagtgcactgtaataattcattttttaaaagattatttaatgcccatttcaaaatacagtagtttacacagctacagaaacaatttggggcaagttttaaaacactgaaacagtaatagttattggtgtcacataaaactgatttgttttttacagccaaacctctgtcagtcagaggcattcattagttttatacatgtaatttgaaaatcactaaacctcgttttctcagcagcaataatttaagaggcttcaaaaatataatttcactcttatttagtattttttcctgggggcatttttacgtaatttttttatgaaaagacaaatgcatgttgagataacttctgggattaaaatagtcttttgctttaaaaaaaaaaaaaaaaaaaaaaaaaaaaaaaaaaaaaaaaaaaaaaaaaaa

SEQ ID NO: 242 - DNA, 2226 bp, Homo sapiens
gtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggaaaaaaaaaaaaaaaaaa

SEQ ID NO: 243 - DNA, 2258 bp, Homo sapiens
ctgctgtcaatcgggccaggtgggagcgatgattggccgccgggcccgccctccagaaagccccgcggggctcgcgtaggctgcaggctcggggagggagggcagcggcgccgcgtcgggagccgccgccgtcccggtcctcccgcccgcccgcccatccggtgcctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctgtacgcaacaggacgcacgacaggagtggttctagactcaggggacggggtcactcatgctgtgcccatctatgagggctttgccatgcctcactccatcatgcgggtggacattgccggccgcgacgtctcccgctacctccgactcctgctgcgcaaggaaggggttgacttccatacctcggctgagtttgaggttgtccggacaatcaaagagcgagcgtgctacctgtccatcaacccacagaaggatgaggctctggagacggagaaggtgcagtacacgttgccagacggcagcacgcttgatgtggggcctgcacgattccgggcccccgagctgctgttccagccggaccttgtcggggatgagagtgaggggctccatgaggtggtggccttcgccatacacaagtccgacatggacctgcgccggacgctgttcgccaacatcgtgctctcaggtggctcaacgcttttcaaaggcttcggagaccgattactcagtgaagtgaagaagcttgccccaaaggatatcaaaatcaagatctcagccccgcaggaacggctgtactccacatggattggcggctccatcctggcctcgctggacacttttaagaagatgtgggtgtccaaaaaggagtatgaagaggatggctcccgtgctattcatcgcaaaactttctagtgcccaaggagggcggggcatgttgggagagggggagggaggggagacagagcctttaaccctttttggtcttggctcgtatactaggcttagggtcccctgcatgccctgaacccctgggtgggtggcacagcagtgcccccctgcagccttcccctctacacaggacatgcacacacaagtaacattgagctgcatggacaggagccttgagctggcgtgtgggaattgagcgccatgtcaggctgttgtgggtatccccctggcagggccagctaggcctgtggttccctgctccgactctcagggctgcctccctgagctccagggccagaatgcctggatgcctgggtagccagtttggggagtgggctgcaaggggcagccagcagctcccactggtgtgtcactgcatccattgccacctcctgttcgtgacctgacagggtgacacagcccctttcacactctgtcctcctatcttcctgggtagatgccctggtgtagggctgagtactgaatggtcttccatccccagcaagggggtgcagcccagggtcaggcccttcagagccagggcagaggatgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaaggcccagtgtgtggctctgttttcttgtggc

SEQ ID NO: 244 - DNA, 3286 bp, Homo sapiens
ccgccagtccccgcgcagtccccgcgcagtccccgcgcagtcccagcgccaccgggcagcagcggcgccgtgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaatgaaatgcttgttgaatcaggggcaaacggagtacagacgtctcaagactgaaacggccccattgcctggtctagtagcggatctcactcagccgcagacaagtaatcactaacccgttttattctattcctatctgtggatgtgtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcgtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttcatggcaaacaggtggatgtgtaaaaatggaataaaaaaaaaaaaagagtcaaaaaaaaaa

SEQ ID NO: 245 - DNA, 4550 bp, Homo sapiens
acaacagtgagctcagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcattacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagttgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagtcaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcaccttagtaagcaccttctaatgctgcattttttttgttgttgttaaaaacataccagctggttataatattgttctccacgtccttgtgatgattctgagcctggcactcccaaatctgggaagcatagtttatttgcaagtgttcaccttccaaatcatgaggcatagcatgacttattcttgtttggaaaactcttttcaaaactgaccatcttaaacacatgatggccaagtgcccaaaagccctcttgcggagcaaatttcagaatatatatgtggatccaagctctgatagttcaggtgctggagggaagagagacctgtgtgtttagaggccaggaccacagttaggattgggttgtttcaatactgagagacagctacaataaaaggagagcaattgcctccctggggctgttcaatcttctgcatttgtgagtggttcagtcatgaggttttccaaaagatgtttttagagttgtaaaaaccatatttgcagcaaagatttacaaaggcgtatcagactatgattgttcaccaaaataggggaatggtttgatccgccagttgcaagtagaggcctttctgactcttaatattcactttggtgctactacccccattacctgagggaaactggccaggtccttgatcatggaactatagagctaccaggacatatcctgctctctaagggaatttattgctatcttgcaccttctttaaaactcacatatgcagacctgacactcaagagtggctagctacacagagtccatctaatttttgcaacttcctgtggccagtgtgtataaccccttccactatctcacagatagtcacagcgtccattccatagtctgtctcctcacatctgttagtattgacacagcacagacaccacaagccatcaggttcttcatggggcaggtgaaatacttctaccccatgggtaaatgtattcacatattaccaagagaagaagcacattatctatgatcttttggcccagttcttatttagcatttttattccagcctacttggaaacatgtttttatttgcaatatatgcctgactgaattaagcttgcttgttttaaacaaccaaatcattggaacagaaaaggatttaaaaaacaagaatgcatgatctcagagtgattaaaaaaaaatcagtggaaataaatgatcatagaaggtgcttttcaaaacaactgctattataattctcaaagtcctactctgccaaaagaagattaaaagtcatacattacattacaaggaaatgttcatgtgggaagagggttgctgaaaatcaacaacgcttgaagttaaaaagtgtgtctttgtagatttcattgtataatgtgtatttcttaggagatggctgacttgattgatctacgctaagtggagacatttcacatttttaaaaccaaatgttcaatctgtattactctttgccgtcttgtatgtagaggctatttttaaatcattaaatttttagatctctgttttcataaaaaaaaaaaaaaa

SEQ ID NO: 246 - DNA, 3431 bp, Homo sapiens
gggggaggagggcggtcgtccggggttaggttgagggggggcgtcggtccgttctgggcgggggatgactcacagcccatcccatctcccagacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttgaaaaaaaaaaaaaaaaaaaaaaaaaaaaaaaaaaaaaa

SEQ ID NO: 247 - DNA, 2855 bp, Homo sapiens
ttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttcagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaacgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaggggggggggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaaaaaaaaaaa

SEQ ID NO: 248 - DNA, 1464 bp, Homo sapiens
cgaagcactggagagtgtcatggaggcctacgagcaggtccaaaagggacccctgaagctgaaaggcgtcgcagagctgggagtgaccaagcggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggcaaatggaaaggatcctaaagaaggcatccaaaacccacaagcagagagtggaggacttcaacagacacctggacacactcacggagcattacgacattcccaaagtcagctggacgaagtagccgcctgcccccagtatggagcagcatcgagggttcgcaaaaggccacactggggttgtgtgtgtttcctttggtatattctggaaacatggctacacacacccttgcatcttctgctacagactgcttttcgaagctgtgtaccctcattctggaacttgattaaagtaagatcgtccttgtactcagtttaggcttcttggcaacatacagaagatacacccttttcgtttggatggaaagtttctaagtttatccagaggtaaagcccattgtgtgtctgtgtcatgtaaaaatgttttcacccgagttgcatgtaatgctctgaggccagccagctgtcttctcctggatgagacagactccagagggtaaggagctagcgccatggtggcctgcagtatgcagagccccgcaggacccagcgtgggcgcccttccaagcttcctctagctttgggcctatgctgtcccctgcaggccctagggaagccacttgcaactatgcggccttcagacttcctcctcagccacctggccactgagacagcatagcctgggtaacggaacagccacctaaggcaagaatggaacggacacaccttgctcctttctgagcccgtttcccaaaaccccccttccaggtgcttctaatgggtgttgccatagcagacgctgctaatgcatcacagcattctttgaaatggaaccagacacagcctgcctctcaatcctcagctgggggctcctagcagcctcttgtatttactcagagttgacacatcacacagatcctgtttggcattcctaccttacggacgtctcaggggtgacaggaccagggcagagccccggtacaaacagacaaggctgcagtcaaatgggagggtccaggtgtccgtgttggagggctgggatcttgtagggcctgtgcgtcctggctgaggatcaaaccacatatgttattgggagaaacgatttctgttgacgtagatattgaaagaataatgaaggcagaagagaaaaacgaagtgtggaatttggggttgtcctgtgtaaattacacaataaagcaaaagtcagttattgtaaaaaaaaaaaaaaaaa

SEQ ID NO: 249 - DNA, 4193 bp, Homo sapiens
tttctccctctggaggcccgagactctccctgtcactgtctgcatctctgtccccatctctcaatctcatgctgagtctctctgtctccaactgcctgtcactgtctttgtgtctctgtgactctcatttctttttttctgtctcctgctgtctctgtgtgggattccttgtctctctgcccctgccctccctctcctatctgaaccctggtctctgtgtcccttagggcttatcacaccgttctccccagagtcaccgggaggagagccgggactggacacaagccagggctgggacaatggcagtgcctagtctgtggccctggggagcatgcctgcctgtgatcttcctctccttgggatttggcctggatacagtagaggtgtgccccagcctggatattcgctcagaggtggcagagcttcgtcagctggagaactgcagcgtggtggagggccacctgcagatcctgctcatgttcacagccaccggggaggacttccgcggcctcagcttccctcgcctcacccaggtcaccgactacctgctgctcttccgtgtctacggactggagagcctgcgcgacctcttccccaacctagcagtcatccgcgggacgcgcctcttcctgggctatgcactggtcatctttgagatgccacatctgcgtgacgtggcactgcctgcacttggggccgtgctgcgtggggctgtgcgtgtggagaagaaccaggagctctgccacctctccaccattgactggggactgctgcagccagcacctggcgccaaccacatcgtgggcaacaagctgggcgaggagtgtgctgacgtgtgccctggtgtgctgggtgctgctggtgagccctgtgccaagaccaccttcagcgggcacactgactacagatgctggacctccagccactgccagagagtgtgcccctgcccccatgggatggcttgcacagcgaggggcgagtgctgccacaccgaatgcctggggggctgcagccagccagaagaccctcgtgcctgtgtagcttgccgccacctctacttccagggtgcctgcctgtgggcctgcccgccaggcacctaccagtatgagtcctggcgctgtgtcacagctgagcgctgtgccagcctgcactctgtgcccggccgtgcctccaccttcggcatacaccagggcagttgcctggcccagtgcccttctggcttcacccgtaatagcagcagcatattctgccacaagtgcgaggggctgtgccctaaagagtgcaaggtaggcaccaagaccatcgactccatccaggcggcacaggatcttgtgggctgcacgcatgtggagggaagcctcatcctcaaccttcgccagggctacaacctggagccacagctgcagcacagcctggggctggtagaaaccattactggcttcctcaaaatcaagcactcctttgccctcgtgtccctgggctttttcaagaacctcaaactaatccggggagacgccatggtggatgggaactacactctctacgtgctggacaaccagaacctacaacagctagggtcctgggtggccgcggggctcaccattcccgtgggcaagatctacttcgccttcaacccgcgcctctgcttggaacacatctaccgactggaggaggtgacaggcacgcgaggtcggcagaacaaggctgagatcaacccccgcaccaacggagaccgcgccgcctgccagactcgcaccctgcgcttcgtgtccaacgtgacggaggcagaccgcatcctgctacgctgggagcgctatgagccactggaggcccgcgacctgctcagcttcatcgtgtactacaaggagtccccattccagaacgccacagagcacgtgggtccagatgcttgtggaacccagagctggaacctgctggatgtggagctgcccctaagccgcacccaggagccaggggtgaccctagcctccctcaagccttggacacagtacgcagtgtttgtgcgggccatcacgctaaccactgaggaggacagccctcatcaaggagcccagagtcccatcgtctacctccgaacgctgcctgcagctcccacggtgccccaagacgtcatctccacgtccaactcctcctcccacctcctggtgcgctggaagccaccgacccagcgcaatgggaacctcacctactacctggtgctgtggcagcggctggcagaggacggcgacctctacctcaatgactactgccaccgcggcttgcggctgcccaccagcaacaacgatccgcgcttcgacggcgaagacggggatcctgaggccgagatggagtccgactgctgcccttgccagcacccacctcctggtcaggttctgcccccgctggaggcgcaagaggcctcgttccagaagaagtttgaaaactttctacacaacgcgatcaccatccccatatccccttggaaggtgacgtccatcaacaagagcccccaaagggactcagggcggcaccgccgggcagctgggcccctccggctggggggcaacagctcggatttcgagatccaggaggacaaggtgccccgtgagcgagcggtgctgagcggcctgcgccacttcacggaataccggatcgacatccatgcctgcaaccacgcggcgcacaccgtgggctgcagcgccgccaccttcgtctttgcgcgcaccatgccccacagagaggctgatggtattccaggaaaggtggcctgggaggcctccagcaagaacagtgtccttctgcgctggctcgagccaccagaccccaacggactcatcctcaagtacgaaatcaagtaccgccgcttgggagaggaggccacagtgctgtgtgtgtcccgtcttcgatatgcgaagtttgggggagtccacctggccctgctgccccctggaaactactctgccagggttagggcaacctcactggctggcaatggctcttggacagacagtgttgccttctacatccttggcccagaggaggaggatgctggggggctgcatgtcctcctcactgccacccctgtggggctcacgctgctcatcgttcttgctgcccttggtttcttctacggcaagaagagaaacagaaccctgtatgcttctgtgaatccagagtacttcagcgcctctgatatgtatgtccctgatgaatgggaggtgcctcgggagcagatctcgataatccgggaactgggccagggctcttttgggatggtatatgaggggctggcacgaggacttgaggctggagaggagtccacacccgtggccctgaagacggtgaatgagctggccagcccacgggaatgcattgagttcctcaaggaagcttctgtcatgaaagccttcaagtgtcaccatgtggtgcgtctcctgggtgtggtatctcagggccagccaactctggtcatcatggagttaatgacccgtggggacctcaagagccatcttcgatctttgcggcctgaggcagagaacaaccctgggctcccacagccagcattgggggaaatgatccaaatggctggtgagattgcagacggcatggcctaccttgctgccaacaagtttgtgcaccgagatctagcagcccgcaactgcatggtgtcccaggacttcaccgtcaagatcggggacttcgggatgactcgggacgtgtatgagacagactattaccgcaagggtgggaaggggctgctgcccgtgcgctggatggcccccgagtccctcaaagatgggatcttcaccacccactcggatgtctggtcctttggcgtggtactctgggagattgtgaccctggcagaacaaccctaccagggcctgtccaatgagcaggtgctgaagttcgtcatggatggcggggtcctggaggagctggagggctgtccccttcagctgcaggagctgatgagccgctgctggcagccgaacccacgcctgcgcccatctttcacacacattctggacagcatacaggaggagctgcggccctccttccgcctcctctccttctactacagcccggaatgccggggggcccggggctccctgcctaccaccgatgcagagcctgactcctcacccactccaagagactgcagccctcaaaatgggggtccagggcactga

SEQ ID NO: 250 - DNA, 6284 bp, Homo sapiens
acacacacacacacggcacctgggctaggcccggacacctgtctgcagcatggataagtatgacgacctgggcctggaggccagtaaattcatcgaggacctgaacatgtatgaggcctctaaggatgggctcttccgagtggacaagggtgcaggcaacaaccccgagtttgaggaaactcgcagggtgttcgccaccaagatggccaaaatccacctccagcagcagcagcagcagctcctgcaggaggagactctgcccagggggagtagaggccctgtcaatggagggggccgcctgggcccacaggcccgttgggaagttgtgggcagcaagctgactgtggatggtgctgccaagcctcctcttgctgcctcgacaggggcacctggggcagtcaccaccctcgctgctgggcagcccccgtacccaccgcaggagcagagatccaggccatacctgcatggcacgaggcatggcagccaggactgtggttccagggagagcctggcgacttctgagatgtctgctttccaccagccaggcccctgtgaggatccttcctgcctcactcatggagactattatgacaacctctccttggcaagcccaaagtggggtgacaaaccaggagtgtcccccagcatcggcctgagtgtagggagtgggtggcctagctccccggggagtgacccaccactgcccaaaccctgcggggaccatcccctaaatcaccgacagctctccctgagctccagcaggtcttctgagggtagcctcggtggtcagaatagtggcattggtggccgcagcagcgagaagccaacaggcctttggtccactgcctcctcccagcgggtgagccctggcctgccttccccaaacttggagaacggagcaccagctgtggggcctgttcagcccaggaccccttctgtgtcagcacccttggccctgagctgccccaggcaaggaggtcttccaagatcaaactcggggctggggggtgaggtttcaggtgtgatgtccaaacccaatgtggacccccaaccctggttccaggatgggcccaaatcttacctttccagttctgccccgtcatcctcgccagctggtctggacggttcacagcagggtgcggtccctgggctggggccgaagcctggctgcacagaccttggcactggtcccaagctcagccccaccagtcttgtccatccagtgatgtccaccctgcctgagttatcttgtaaagagggtcccctgggctggtcttctgatggtagcctgggatctgtgctcctggacagccccagctcccctagggtaaggctgccctgccagcccctcgtcccaggtcctgagctgagaccctctgctgctgagttgaaattagaagccctcacccaacgtctggagcgagagatggatgctcacccgaaggctgattactttggagcctgtgtgaaatgcagcaaaggggtgtttggggctggccaggcctgtcaggccatggggaacctctaccatgacacatgcttcacctgtgcagcttgcagccggaagctgagaggaaaagccttttattttgtcaacggcaaagtgttttgtgaagaagacttcctgtactctggtttccagcagtcggctgacaggtgttttctttgtggacatctgatcatggacatgatcctgcaagccctggggaagtcctaccaccccggctgtttccgctgtgtcatctgtaatgagtgtttggatggggtgcccttcaccgtggactcagagaacaagatctactgtgtccgagattaccacaaggtgctggcccccaagtgtgcagcctgtgggcttcccatccttccacctgagggctcagatgagaccatccgtgtcgtgtccatggacagagactaccacgtggagtgttaccactgcgaggactgtggtctggagctcaatgatgaagatggccaccgctgttatccgctggaggaccacctgttctgtcactcctgccacgtgaagaggctggagaagagaccctcatctacagcccttcaccagcaccacttctagccagagccacttgcagacatcacggcaggggatgaggagccggggttgctgctgctgcttccggtggcccctggggtggaagtggggtaggggaagaggaggggcaggagggagagttcctgtgagcatgtggggggtgcctttcctttaaccagggaggtgaacactacctgcctcctgcgtgtattttccaagtgcttttctctgttgccacattttcctcaggttactcaggaaaatgctccagcatgtgcgagcacatgacctgaggttgcatcatagcaccaaaggaatcctcctgtcccctctgggaacatttcatgcttcagagggagaggtttttattgagcttgtttcacaatatccccttgaagggacagctcagctgccaatacattcaaccctttctcttccttcaggaaaatacctatacccaaatgttccctcccccgacatatatcatggcatgatttaaggcttcttttcacctgagagcttcagttcttctgcagaatggctgcaaatttaattgcattaaggcaagaaggaagctctaatgtgtgctttgtatcctaagataaatttgcttagaaaaccagagtcaagatttgaaataggtgaggcagggtttcctccttagacactgacagcattctctgtaccccttcaaatccttactctcctaaaggcagctgagtccgcgacagaaatttgccctatgtgagtaaaacatactttgggagaagaacttggtgcaggcaccaggatttttttttttgcccacgtgtttgcgctgtttttctctggagttctcaagagttggtgacttggaaggccgcttctgcaaggcaagtctcaggaacccatgcaggtacatcgcttgcacctgtttttagcttatttaatgacgggcttttgggaagagctgcccgcatactgagagacagcttcttataaacaaggagagtttttgtgtgtgcgagatctctaagccagcgtgggagggagcgcctcaggataagttattatattcatttcgttggtttctctcctgcccaattcttggcacaggcattatgtttgaagaaaccaggataaggtacactgcttttgtctgtttaatttttttagttgtttcccttcactttcagtcttccacacacaaaaaatacctcacagagcttcaccaaatcacagattcaggaggaatttggctttcacactggactcagataccttcttcagtgtgttggaaatcactggcttcacacaggcccaactccagctggtcagggcagagtgatcgtaactaaaggtcagtggggaatagatccgattcagtgcttttgccttatgcatttcagcatcctggctccccagggtggcaggagctgagggagggccacacactggcaagatttcaagaccactctctgcactgaagaggtaaaatttgcactgcaagtcacatccctgaggccagaggtcagtaccctttggtatttcgattagaagaagctgcaaaagaaaggcagcccattttaccattgccagccaggccggggacacaggagccggtgtgtgcactctgcctcctcaccttgcacccagagcaagaggactgggtgctgggctgcagaggccggtcagtggagcccctagcacgtgtgaactcaggcttttcattgggcccggctccacttctaggccatgttttgactcatttggtaaccattgcctgtaagcagcacagaattggtgccatggattatcttttccatgttgatggaattcattctgttggaatcctttggccagatgtcacttcagccagggtgtgcatcatcattggttctttttcacaggctgagcctcctgaaaacccatgaacgctggggctggggaagtgaaccctgaggtggggaccctctcttcccatcaaatcatccagctcagtgtggggcgtggcaggggggtaaatgaagccagccaatgtgttaacctgtctctgtcaacctaagaatgttggccttactgacacacctttgctccatgttcaagaccagaagtagctgggatttgtttgcaaattgggtaattagtttaaaaatctgtgattacatttttaaatgaaattttcaaagtggcctagattgaggtgattcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggcccttacacaaaagccatgaagagatgttcacctacccggtattttaaatgttctgtaaattattagccaaatagaactgtaatggggttgtatttatgggcgcctagaaagaaaacacaaggacttggtaggccaggaagaaaagattttaaaatttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcgtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttctgtcacacaaaatgaagaacagaaatgttaggacttaagagaatgtttggaattcacacctctttgcagtcctttcaaggctgctgctctgtgctgtgtcccatgcatgtgaaagtagagctgtgatggctgctgggacgcttgcaaagatcatgtgtgagaattgagcacaagaccacaaattattactgcttgatgcgcttgttaaaactctatctgccaggaaaccaaattttcttttcttttctttttttttttgagacagggcctcactctgttgcccaggctggagtgcagtggcgcgatctcagctcactgcagcctccacctactgggctcaagtgatcctcccacctcagcctcccgagtagccgggaccacaggcgtgtatgactggctacgcctggctaatttttgtatttttaatagagacgagtttcaccatgttgcccaggatggtctggaactcctgggctcaagtgatctgcccacttccgcctcccaaagtgttgggattatggccattagccactgtacctggcacaatttttttttgtaccctcctttatgccaagaatcagtcctaatttctttactatgtgaagtaacttttaaaggtaatagaaaaggccaggcacagtggctcatgcctgtaatcccaggcgccgtggctcacgcctgtaatcccagcactttgagaggctgaggcgggtggatcacttaaggtcaggagttagagaccagcctgaccaacatggtgaaacactgtctctactaaaaatacaaaattagctgggtttggtggcgcacgcctgtaatcccagctacctgagaggttgaggcaggagaatcgcttgaacctgggaggcagaggttgcagtgagccgagatggtgccattgcactccgacctgggcaacagagcgaaacactgtctcaaaaaaaaaaaaaaaagtaacagaaaaaagagtgaaatatattagctatcttttattctgagccaaaacttgacagatgtgggaaatcttcatatagtgtatgaaaatttcattgtacagggaaattattttcctctgtgtcttttcttttactataaagtgattcagaattttactgttactataaaattatgcaaagtattgtgacaaaactgcatcaatttgttgactattaaagtgctccttgaacatta

SEQ ID NO: 251 - DNA, 2010 bp, Homo sapiens
gccggggtctaggcaccacggtggctggcggcctgcgggcggcgctgtggcccgtcgggcggctccacagagccgccctagccttccgccttccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatggatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgttacagtaacaaataaagtgcagtttaaaacccaactcttactcttaatttgttcctaatacgtatttttggcagggagagggaacggtccatgaaatctttatgtgatataaggattttaagtttgggccagtgaacagggtaaataaaatttaacttttgagcatatggaattttgattgcctttaaagttactattctgtatcattgattcatcaagaaaacctagatctgcactcacctcactgttcaatcattgagtggtaaaggacagaagtattttctagttctggtcagatgatataattttttttttttttttttgtgggggtgaagtcttgctctgccacccaggctggagtgcagtggcatgatgtcaactcactgcaacctccgcctcccgggttcaagtgattctcctgcctcagcctcccgagtagctgggattacaggtgtgtgccaccacacccggctaatttttgtatttttagtagagacgggatttccccatgttggccaggctggtctcaaactcctgacctcaggtgattcgcccacctcagcctcccaaagtgctgggattacaggtgtgggccactgcacctggcccagatgatataatttaactgtgttttaggtaacatgttaatgagggaaaatgtttaccagtgtagcattggatcaaaaagtttatcacacagtgttttaataaatggtttattctgcttaccttatttgaattgtcattataattttatatgcaaccttaatttgtcaagtaaatactttcatttaatttgaaagaattcatattcatttgctctttcatttgacaataataaaatttaaggtttattacctggaaagagtgcaagaaaatactaaacaactttatcaaactgattcacactgaggggaggttattttgtaacaaataatggaccacaagttcattttgtattcttctgtagtagaggctactgatatgaatttaagaaaaaaccttagaatcttaacttttcacatctgcagatgcagtgtgccattctgaatttttcaatctaagggatgtggatacatagaatgtttaaaaagataacaattagaatgaaaaattaaaattatgtatgcttttaaaaaaaaaa

SEQ ID NO: 252 - DNA, 5629 bp, Homo sapiens
cttaagtgcaaggaactctgtgttgggaggaaaaatgtccttcttcaatttccgtaagatcttcaagttggggagcgagaagaagaagaagcagtacgaacacgtgaagagggacctgaaccccgaagacttttgggagattataggagaactgggcgacggagcctttgggaaagtgtacaaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttggatcctcattgaattttgtgcaggtggagcagtagatgctgtgatgcttgaacttgagagaccattaactgagtcccaaatacaagtagtttgcaagcagactttagatgcattgaactacttacatgataataagatcatccacagagatctgaaggctggcaacattctctttaccttagatggagatatcaaattggcggattttggagtatcagctaaaaacacgaggacaattcaaagaagagattcctttattggtacaccatattggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtcttcaaattttaaggactttctaaagaaatgcttagaaaagaatgtggatgccaggtggactacatctcagctgctgcagcatccctttgttactgttgattccaacaaacccatccgagaattgattgcagaggcgaaggctgaagtaacagaagaagttgaagatggcaaagaggaagatgaagaggaggaaacagaaaattctctgccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagaaacaagaagacaaaagaaaacattgaagaaaacacgcaaatttattgttgatggtgtagaagtgagtgtaacaacatcaaagatagttacagatagtgattccaaaactgaagaattgcggtttcttagacgtcaggaacttcgggaattaagatttcttcagaaagaagagcaaagagcccaacaacagctcaatagcaaactacagcaacaacgagaacaaattttccggcgctttgagcaggaaatgatgagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggttataaatgaagtggagaaagcacccaaagagctgagaaaagagctcatgaaacgcaggaaagaggagcttgcacaaagccagcatgctcaggaacaagagtttgttcagaaacaacagcaagaattagatggctctctgaaaaagatcatccagcagcagaaggcagagttagctaatattgagagagagtgcctgaataacaagcaacagctcatgagagctcgagaagctgcaatttgggagctcgaagaacgacacttacaagaaaaacaccagctgctcaaacagcagcttaaagatcagtatttcatgcaaagacatcagctacttaagcgccacgagaaggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacagtttgctgcacaagaagaaaagaggcagaaaaatgagagaatggctcagcatcagaaacatgagaatcaaatgcgagatcttcagttgcagtgtgaagccaatgtccgcgaactgcatcagctgcagaatgaaaaatgccacttgttggttgagcatgagactcagaaactgaaggagttagatgaggaacatagccaagaattaaaggagtggagagagaaattgagacctaggaaaaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaattggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcagaaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgttaaaaaaaaaaaaaaaaaaaaaaa

SEQ ID NO: 253 - DNA, 3735 bp, Homo sapiens
ctccctcgagtccctgagtctctgtagtgcctcagctcctggatgtcctcccttaaaggagaagaacaatgcgggccgactagacgagtcccttagtttcctcgccggcgcagacaaatacggtttcagtccaaggaactaccattcccagaagacagcggggcgttccttgctgcatttctattggttggcgtttgttactcccagccaatagaaagtgagcttcttgacaagtgccaaaatggcgatgcctaccacctagaactggattgtgcgctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggctccctttgtgaaaaaaaaaaaaaaaaaaaaa

SEQ ID NO: 254 - DNA, 1870 bp, Homo sapiens
agctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgatagcatcgtctgctattcatgtgttgagttttatacttctttatggatggtgtatgtgaaatgtggagacttccacattctcagtttattcacattgtgatactacctttgaaggtttttttgtttttgttttgttttttgagatggagtttggctgttgtctcccaggctggagtgcagtggcgtgatcttggctcactgcaacctctgccttctgggttcaagcgcttctcctgcctcagcctcccaagtagctgggattacaggcgcctgccaccacgcctggctaattttttgtatttttagtagagacggggtttcaccatgttggccaggctggtctcgaactcctgacctcaggtgatccacctgccttggcctctcaaagtgctgggattacaggcgtgagtcactgcacccaagcctcctttctcttttgcctattaaacctctgctcttaaccttaaaaaaaaaaaaaaaaaa

SEQ ID NO: 255 - DNA, 5038 bp, Homo sapiens
agcggagcgcgcatgcgcggtcgcctttgtgtgggtcgagcagcggcggcggcggcggcagtggcggtcccactggcaggcgggcaagaggggagtccgggcggcggccggcgtgggagccgggggaccaccatggtaaagaagcggaaaggccgcgtcgtgatcgactcggacacagaggacagcggcagcgacgagaacctggatcaggagctcttgtccctggcaaagcgaaagcgcagtgactctgaggagaaggagccgcctgtgagtcagcctgcagcctcgtcagactcggagacgtctgacagtgacgatgagtggacatttgggagcaataaaaataagaagaaaggaaaagccagaaaaatagagaagaaaggaaccatgaagaaacaggccaacaaaactgcctcctcaggcagttcagacaaagacagttcagctgagagctcagcccctgaggaaggtgaagtgtcagactctgacagcaacagctcctcttccagttcagattcagactcttcctcagaagatgaagagttccatgatggctatggagaagacctcatgggagatgaggaagacagggcccgtctggaacagatgacagagaaagagagagagcaagaactgttcaatcgcatagagaagagggaggtgttgaaaagaagatttgaaatcaagaaaaaactaaaaacagccaaaaagaaagaaaagaaagaaaagaagaaaaagcaagaagaggagcaagaaaagaaaaaactgacacagattcaagaatctcaggtaacatcccacaacaaggaacggcgttccaagcgggatgagaaactagacaagaaatctcaagccatggaggagctaaaagcagagcgagaaaaacgaaagaacagaacagctgagctccttgccaaaaaacagccattaaaaaccagtgaggtctactctgatgatgaagaggaggaagaggatgacaaatccagtgaaaagtcagaccgctcatcacgaacatcatcgtctgatgaagaagaggagaaagaagagatccctcccaaatcccaaccagtttccttacctgaagaattgaatcgggttcgattatcacggcataagctagaacgctggtgtcacatgcccttctttgctaaaactgtcacaggatgttttgtgcggattggcatcggaaaccacaacagcaaaccagtttaccgggtcgctgagattacgggtgttgtggaaactgccaaagtttaccaactaggtggcaccagaacaaacaaagggctgcaactacggcatggcaatgaccaacgcgtgttccgtttagagtttgtctcaaaccaagaattcaccgaaagtgagtttatgaagtggaaagaagcgatgttctctgctggcatgcagttgcccactctagatgaaatcaataaaaaggaattatctattaaagaagctcttaattataaattcaatgatcaggacattgaagagattgtaaaagagaaagaaaggttcagaaaagctccacccaactacgctatgaagaagactcagctactgaaggaaaaggccatggctgaggacctgggggatcaggacaaggccaaacaaatccaagatcaactgaatgagctggaggaacgggcagaggccctggaccgccagcggaccaagaacatatccgctatcagttacatcaaccagcggaaccgggagtggaacattgtagagtctgagaaggcccttgtggctgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaactgccagtcatctgtaatataaaccatttgctgtatagacctcctttgtctgcacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataaactgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgcatcacactgtagccactttgccaccacctccccacatgtagccgctgaaacccccacgagatgccaatgcacacagcagggagaaaagccaaccaaagaagaccgaagggtatctttccacccgagtagcctctgtagtgattgggaccaagactaaggacttgtctccaatctcagctgaggcagtgcctctgaaccaagatcttggtcaggcattaagacactggctttgtcctaccaactaggatttcttggtggttcacactatttcttgtgctggggaattccctcattgggcccctcctccctccacagtgtggtttcagtgttgaagggtgcagcacccaaggttgtttttatgcattttttcagttccttccaagaagcaaaaaggccagtgtccatctgcctagttcataatgtttataggtctgtttgtctgtcttgcttctggcaggtgtagggaaagtctactgcctgccactcccttcaaaaagaatgtttttgcttttgtgaagtcctgacttgccactcaaactgtaccaatattgtaaataaatgttatgccattttaacaaagggaaaaaaaaaaaaaaaaaa

SEQ ID NO: 256 - DNA, 4918 bp, Homo sapiens
ggttgccatggggacctggatgctgacgaaggctcgcgaggctgtgagcagccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggatggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggtggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtaccctcgaccctcctgggtgttggttggagcagaactggtgaggatgtttgatccgagattttctgagctctccccaatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgtggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttctttttttttttcttttcttttttaaaaatatgtggctgtgaacttgaatgaacactgctcaaactttctgctattggggggggcgggtgggatgggaagaaggggcgtttgttttattcttggtgttttcagtgcaataaatagctacaaacttctgtgcaaaaaaaaaaaaaaa

SEQ ID NO: 257 - DNA, 4303 bp, Homo sapiens
cccgccccttcgcggcgcttcctagttcggctggttcttctgtcgccggcttcagcagcccgcgcccgggcaggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccctacccattagtatcacccccagttcttacagtaatccctgagaaatctccttcaagcatcaccaaacacagtttgaaaattacagggttagcaaaaagagcctgggctgtatgtagggtggaaacactctgatctgaagcccagctgactccactactaatttgctgtaaagctttggacatacacttagctgctgtgagccactaataacattgggctaatatctgctgtgcttctctgacaggtagtcatgaaaatcaaatgatgcaaaatatatacaagcactttgtaaattgtaaaatgatacaaaatttaaagtttatagagccagttacaaaatcctattagtcatatatttatagattgtgttcacagcaatcatttaaccacaaataaaatatcccttgatgatactgccataatgatatgtccattattagattatgttacatgacaaagttgaaggaatttggcagatgcagttaaggttcctaaacaactcactttgagactgttgaaagggcctgacctaatcaagtgaacccttgcaagaagaattctccttgtaagccttgaagaagtatgtgagagggccacattggctaaaacctaaaggtggcctctaggagatgagacctaccttccagttgtcagcaagcaggaaaaaaaaattgggacctcagttgcaaccacaaggaactgaattctgccaaaaatctgagtcagcttagaagagtactccaagcttcagatgataaccacagcctgggctgacacctggatttcagctttgcatgatcctcagtatgagaatctatctgttctgtgctggacttctaatatatagaactgtgagataatgggtcacattggctggatgtggtggctcatacctgtaaatcccagcactttgggaggccgaggcaggcagatcacctgaggtcaagagttcaagaccggcctggccaacatggtgaaaccccgtctctactaaaaatacaaaaattagacgagcgtggtggtggacacctgtagtcccagctacttgggaggctgaggcaggagactagctggaaccagggaggtagaggttgcagtgagctgagatcgtgccactgcactccagcctgggtgacagagtgagactccatcataaataaataaataaataaatgggtcacattaagcctttaagtttgtggtaatttattattcagtaatagaaaacaaatacagatactctcccatgatgtttttcccatgatgatttcccatgatatttacaggttttgcccacatttgaggggtatgtggaaattatacagagcatgtacagcgggaggcttatagtgtacgtactgaaatgtggggttggagccccaacacagagaccccagcaggacactgcctagtagagctatgggaagggtgctgccaccctccagacttgagaattgtagagccaccagcagcttgcactctgagcttggaaaagccacaggcactcaacttcaaccatgagggaagccacgcaccctgcaaagccacaggagtggagctgcccacggcctcgagggcccaccccttgcaccagtgtgccaggatgtgggacatggaatcaaggaatatgttagggcttttttttttttttttttgagacggagtcttgctctgttgcccaggctggagtgcagtggcacgatctcggctcactgcaagctctgcctcccaggttcacgccattcccctgcctcagcctccccagtagctgggactacaggtgcccgccaccatgcccagctaattttttttgtatttttagtagagatggggtttcactgtgttagccaggatggtcttgatctcctgacctcgtgatcacccgcctcggcctcccaaagtgccagtatttaaagtttaatgtcttcccagctgggtttcagacttgccaggatcctgttgcccctttctttagccaatttctcccttttgggacaagaatgttttacttattgcctgtaccaccaactgtatcttggaaataaataacttatattttatttcagaggctcataggcggcaggaacttaccttgagtctcaaatgagacttaggacttttgagtgatgctagaatgagttaagactttgggaagggatgattatattttgcaatgtgagaaagacattagatttggggggctgggggtagaatgacattgtttagatgtttgtctccttcaaatttcatgtttaaatgtaatccccagtgttgggggtggaggtggggcctgatgggaagtgtttgggtcatggtggatgatccctcatgaatggcttagagccactggtgatgagtgagttctcactcagttcgtgtgagatctggtggcttaaaagagtctgctccccctttgccttccattgtgattgtaaccttcctggggccttcatcaaaggccaggcaaatattggtgccgtgctagtatggcctgcagaaccgtaagccaaaacaaaccttttttctttataaattacccagcctcagttattcctttatagtgatgcaaaacgggctaactatataaatttgtaatttttaagttatagattgtttttattaaacacttatgaatactgttaaaaaaaaaa

SEQ ID NO: 258 - DNA, 4337 bp, Homo sapiens
ggaggctgagcgggcggcgcgacgcgggggccgacgggggcgccgggtggccgcgccggaagtgccttgcgcggcagaggaagcgcagggacagagcggagcaggccgagccggcggaaagggtctttgctgctgcgcccgggcaggggctgccgcggccccaggtcccgcttcgagacgcggcgcggtccaggcgggaggcgactccctaggaagggacccggggcgggaggaggaagtgaggccgcgcggaaggaaggcggcgagccccggggccccgaggccttggccgcgtcacagcacccacatggcctctggagtgggcgcggccttcgaggaactgcctcacgacggcacgtgtgacgagtgcgagcccgacgaggctccgggggccgaggaagtgtgccgagaatgcggcttctgctactgccgccgccatgccgaggcgcacaggcagaagttcctcagtcaccatctggccgaatacgtccacggctcccaggcctggaccccgccagctgacggagagggggcggggaaggaagaagcggaggtcaaggtggagcaggagagggagatagaaagcgaggcaggggaagagagtgagtcggaggaagagagcgagtcagaggaagagagcgagacagaggaagagagtgaggatgagagcgatgaggagagtgaagaagacagcgaggaagaaatggaggatgagcaagaaagcgaggccgaagaagacaaccaagaagaaggggaatccgaggcggagggagaaactgaggcagaaagtgaatttgacccagaaatagaaatggaagcagagagagtggccaagaggaagtgtccggaccatgggcttgatttgagtacctattgccaggaagataggcagctcatctgtgtcctgtgtccagtcattggggctcaccagggccaccaactctccaccctagacgaagcctttgaagaattaagaagcaaagactcaggtggactgaaggccgctatgatcgaattggtggaaaggttgaagttcaagagctcagaccctaaagtaactcgggaccaaatgaagatgtttatacagcaggaatttaagaaagttcagaaagtgattgctgatgaggagcagaaggcccttcatctagtggacatccaagaggcaatggccacagctcatgtgactgagatactggcagacatccaatcccacatggataggttgatgactcagatggcccaagccaaggaacaacttgatacctctaatgaatcagctgagccaaaggcagagggcgatgaggaaggacccagtggtgccagtgaagaagaggacacatgaaggcttgctacccccagtggaaaatcatcccctccccttgtgtgtatgtgacagcgtgtatgtaacggcttctgatttctgtgaaagctgctcagcaacaaacgtacttccaccagatgtgtccccagatccacagcaggcacatatctctccaagggatgaccagttttatgcttactgtgtgcttctcatcccctggttgtggtaggtcaaggaaaagagcccctttgatccaccaggagcaattaagaaaggtccttcaggtaatccctcaatggctgctttgaacttactcaggaaagccagcccccataatattgtattaccaaacagtatcgctttgttaggaaggatctggaataatcttgaagggaagtcagagttttctccctgcctattaacaaaaacccaattttgttcatattgaagcatgaaataaatgagagcaaggtagggccaaattaactcttgtggacagtccctaaaagtccagttctacatttgtgaaaattgtggtgccatgaattaagatggatgactggaaaaaggtgttggagaaagagttaaagatgaggaagagatatttttagtatatgaagttatccaggacttgatattcataattcagtgctgtggaaatgaaaaaaatgattgaagaggtggaacggaaatgaccttagggggaaaaaaaaggaccaaagaagtctgattaaaagttgaaatcagtatttctgaattcaaattgcttgaatttccaaaatagtcagtaaaggatctaatagaaccagaattatttgggtgaattctgcaggttttatgggcttgtcacaacgtgaagggctggaatgtatattaccaaatgggaatttccattgtaggtttttgctagtcccacccccattttagcctaatttggcttaaacgcagtatggggagaattgttcccattccatgtgttctgaattcagctcatctcccagcatatagatatatcctcctttaactccgaccagaacccttcttcctgtggcactccccacccatagaccttcagatcatctcccacaccctggatctcactctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactgggggaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaaaaagcatttttctctcaaactgatggccaagaaatggctaggacaattttggtgctttacctatctctgcaaagactggagaatttggcataccattaattacaaccaccaatcatatccaacaaaagtaccctaaaagaaggaccagtggccactctcgaaaaaatttaagtatcagaagattaaaaagattttaggatttggaagcttgtattgtctttccccaataatcattgtttgatctccaaatagtagccttatattagcaatagacagatcattggttctccatatctgatcatatgttactactttgaatcagtatttgggaaattcaagcatttatgcagtggatataaatggaaatataaaaatatttgccaacctgtctcagtaacttatcatatctctgtgatcctcaaggaaagcacttttgcttttacttagaaagcgtttcagatttgctttatagactcctgctgtcttcagtacctgataaaactttaaccagggaagcattaaacacagtgcagcagcttttgcccaggcttctaagttcctgccggcagcatttatcaatgtaagaactaggatgcttcctgcagtggcactaccttcccctagagctggagcatgctgcttggccttaagccccagcatgatgaggcttccctcctgccaggtcagtaaaagttagagagctcagaattgggtcttgcctgggtgcaggtggcagggtttgctgaaacccctaaagagaagtcaccaagggaggcaggtaatgaatgtttccagaatcagtcggatactcatagcaatttctggctatctttcaaatgttgaatttctggatgctgagagggactttgatttgatatcattaaatccaggacagtcccaagaagtgcttggagtctcggctctgacagcccaagaagggaaataacttgtattaaggaacaactatgagccaggccctgagctgtctcttagataataaaacagatggggagtggaagagtcatttgcttcaagttatacagctaggaaatactcaagccaaatcttgaacgcagctccccctaattctgtggacaggcactttgtaccacacaccatggtccacctaaaaacagaaggataaaaagacttcaggtt

SEQ ID NO: 259 - DNA, 2193 bp, Homo sapiens
aagtgtggccacttcctcttgcctgtcctgactcaccctggctgctgcccattgtggctgccatggaaatacaactcgaggagaacccagaccaggacagggaggccatgttctgggtggcagtggagcctggcaaggtgccctcctggcctgggactgctgtggcagaggaagcatgaggtggggcctggcctgcccagctcagagctgaggtgcccccttggttttttacctccctgctccctggctggcccactgcacccacgcactcaacgcagtggcttcgctcctcctccaggatggctggaggtgggaccattgccaggatggcctcaagtgcccagccctcctggaagactcagtttccctctttgtcccatgcagaggtgcagagattcattattgtgggaccatccgtgaaaccggtgccaggatgcaccgggggtgtggatgaccggccgcccagccccagcacggcccggtcccgcatgccaccgccccgcgaggaccgctctccaagggctgcctggggccccgcgcccgtactctcctaacccggagctcttggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccgaccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggaactgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccgggcgttcctatggtcaaagagtggaaatgcaggaaccaacctcccttt

SEQ ID NO: 260 - DNA, 2082 bp, Homo sapiens
gaaagagccgagtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagtgagcccttctctgtgttcccagggtctgctgagggccgtgtctggtggggatggggctgggctcaccctcaggagtagggctggggagtcgtgaacgggactcaggtgtgggaagaggcgagagggctgtggaggagctcgcacggcgccaggtgatgggctgcacaggcactgtcccctgcctgcgtcctggggcctgtgcactgttgcgtccatgctcagagtggctgagacttgtgtcctgaccaggccctgcttacctctgttttggtttttgtttttgatatttttttttccattgtgtttttacgtagtgtcatgttctgtgcatatagtgttgtattctcctttgcactgtttatgttacagtgaaggctctccttattaaaaatcttcgcaaaggtcactttttaatggctatctaacactccatatgtggtgggcaagtctggttggcctccggggggtttccaggtataggggatgtagggccttgcctggcctggtctgcgggtccatcgtcagtgcctgagcggccagcagaaggggggcagcagcctccactgagcctctggttcccatttcccaggttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctgaggctgcggggggtttctgc

SEQ ID NO: 261 - DNA, 2023 bp, Homo sapiens
agcctgccgcttccggctctggcggggggggcacgtgccccgtcccgttgccccggcgaccgcggcggtttgttctcaggccccggcctttctcaccgtgcgacgccccaacccgccgctccgccgcggtggtacgctccaggccgccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaa

SEQ ID NO: 262 - DNA, 3639 bp, Homo sapiens
agaccggaaagggctcgggtcatcccggcgcccagggtcaccttcccacgggctggcacctgggcgcgggcgctgccccggagccggccggcgggacctggcgcccaatcctgggggacccggtgccgtggcccaggggccgggccgaggtcccgggggcggtgccttgcgggcccgtcccggggcggtgcctggtgggctggccccgcggctcctcccctctctgcgggcccagtcgccctttggccgggcgagctaatcgtcggctcaatgacgacgaggcccgacccttcccgtccaggacctacagagacaaccgaaggagagcccaaggcggcttctttgctgtcgccgcccccactgaagcaagagctccccggctccactgaaacaccagctcatttaagctttccccaacgcccggccctccgggacgatacctaacaacgaccggcgcccgcatctggaataggctggcgagatacttagtatccgagggctcgggacttggcgccatcgaggtcatggggacccaggatccagggaacatgggaaccggcgtcccagcctcggagcagataagctgtgccaaagaggatccacaagtttattgccctgaagagactggcggcaccaaggatgtgcaggttacagactgtaagagtcccgaagacagccgacccccaaaagagacggactgctgcaatccggaggactctgggcagctgatggtttcctatgagggtaaagctatgggctaccaggtgcctccctttggctggcgcatctgtctggctcatgagtttacagagaagaggaaaccctttcaagctaacaacgtctccctaagcaacatgataaagcatataggcatgggcttgaggtacctgcagtggtggtaccggaagacccatgtggaaaagaagacacctttcatcgacatgatcaattctgtacccctaagacagatttatggttgtcccttgggtggcatcgggggaggcactattacccgtggctggagaggccagttctgtcgttggcagcttaaccctggaatgtatcagcaccggacagtcatcgctgaccaattcacagtgtgcctgcgtcgggaagggcagactgtgtaccagcaagtcctgtccctggagcgcccaagtgtcctccgcagctggaactggggcctgtgtgggtactttgctttctaccatgccctctatccccgagcctggactgtctatcagcttcctggccagaatgtcaccctcacctgccgtcagatcacacccatcttgccccatgactaccaggacagcagcctgcctgtaggagtctttgtgtgggatgtggaaaatgaaggggacgaagctctagatgtgtccatcatgttctccatgcggaatggactgggtggtggagacgatgccccagggggtttgtggaatgagcccttctgtctggagcgtagcggggaaactgtccgggggctgctcctgcatcatccaacccttccaaacccctacacgatggctgtggctgcacgagtcacggcagctaccacggtaacccacatcacagcctttgaccctgacagcacggggcagcaggtgtggcaggatctacttcaggatggacagctggactctcccactggccaaagcacccctacgcagaaaggagtaggcattgctggagctgtgtgtgtttccagcaagttgcgacctcgaggccagtgccgcctggagttttcactggcttgggacatgcccaggatcatgtttggagctaaaggccaagtccactacaggcggtatacaaggttctttggccaggatggagatgcagcacctgccctcagccactatgcactgtgccgatacgcagagtgggaagagaggatctcagcttggcagagcccggtattggatgacagatcactgcctgcctggtacaaatctgcgctgttcaatgaactatacttcctggctgatggaggcacagtgtggctggaagttcttgaggactccctaccagaggagctgggcagaaacatgtgtcacctccgccccaccctacgggactacggtcgatttggctaccttgagggccaggagtaccgcatgtacaacacatatgatgtccacttttatgcttcctttgccctcatcatgctctggcccaaacttgagctcagcctacagtatgacatggctctggccactctcagggaggacctgacacggcgacggtacctgatgagtggggtgatggcacctgtgaaaaggaggaacgtcatcccccatgatattggggacccagatgatgaaccatggctccgcgtcaatgcatatttaatccatgatactgctgattggaaggacctgaacctgaagtttgtgctgcaggtttatcgggactattacctcacgggtgatcaaaacttcctgaaggacatgtggcctgtgtgtctagctgtgatggaatctgaaatgaagtttgacaaggaccatgatggactcattgaaaatggaggctatgcagaccagacctatgatggatgggtgaccacaggccccagtgcttactgtggagggctgtggctggcagctgtggctgtgatggtccagatggctgctctgtgtggggcacaggacatccaggataagttttcttctatcctcagccggggccaagaagcctatgagagactgctgtggaatggccgctattacaactatgacagcagctctcggcctcagtctcgtagtgttatgtctgaccagtgtgctggacagtggttcctgaaggcctgtggcctaggagaaggagacactgaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcctggccaaaagtcaaacagggcacaggactaaggacagggcctatgtttggaccaaaggaagccatggcaaacctgagcccagagtgagccgtctgaactgtgggagggaagtgctaacagcccagcctccagcctggcctttcctccttcccctctgaacctcctgcaaccctgagccatcaggacaatcataccccttcccttctctccacccaattgtgccagtaaatgggggttgagggtgacctaggcagcattagaatcacttatttatttctttcctcacctgttccctgactgcgtgaaatgttcagggaggtcagttgatttccccaggtacattcatggtgtgacagacacatgggtacaaataaaagacccagaaagccaaaaaaaaaaaaaaaaaaaaaaaaaaaaa

SEQ ID NO: 263 - DNA, 1881 bp, Homo sapiens
agtgccctccccgctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagtggtcggttgcggacgtggcctctttggttttgttttctcagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagcctgaaaaaaaaaaaaaaaaaa

SEQ ID NO: 264 - DNA, 5375 bp, Homo sapiens
ggggccggtctcgcgcggtctagaagtggagttgctggcggctgcggcggtgacggcggcgacggaggaggcaggcggtggggcgggggcggggactaaggattctgaggtggggagtcgggagtttctggattctttatccggaatttcaagggccgccggagggctgtcgcttctgcagtgcgtaggagcggccggggcgggaggctccgcggagccgaggcgtggagaataagaaagccttgagttttgtgaaaaaccggagaagagaaactaaaaggacagtagaaaaggcttttccagtttgcataatatttccttcatggatactttttcatagcattattatgtgatgtgagaagtttttttttttgaagtaacatggattttatactacagaatcaagagaattggcttataggaaaaattgatttataaaaagtggtacaggttttcatagataaccatgacaacatcccatatgaatgggcatgttacagaggaatcagacagcgaagtaaaaaatgttgatcttgcatcaccagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactgtggccagaatgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaagggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccatttaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaagccaaaaaaaaaaaaaaaaaaa

SEQ ID NO: 265 - DNA, 1357 bp, Homo sapiens
cagcattttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcactctgaaaaaaaaaaaaaaaaaaaaaaaaaaaaaaaaaaaaaa

SEQ ID NO: 266 - DNA, 1678 bp, Homo sapiens
aggacccgagctacggtggccgcggggcggcggtggcgattggacttggtgggtcccgggccaggggcgggcgccgccatgggtaacctgttcggccgcaagaagcagagccgcgtcacggagcaggacaaggccatcctgcaactgaagcagcagcgggacaagctgaggcagtaccagaagaggatcgcccagcagctggagcgcgagcgcgccctggcccggcagctgctgcgggacggcaggaaggaacgggccaagctgctgctcaagaagaagcgataccaggagcagctcctggacaggacggagaaccagatcagcagcctggaggccatggttcagagtattgagttcacccagatcgaaatgaaagtgatggaggggctgcagtttggaaatgagtgtctgaacaagatgcaccaggtgatgtccattgaagaggtggagaggatcctggacgagacgcaggaggccgtggagtaccagcggcaaatagacgagctcctggcaggaagcttcactcaggaggatgaagacgccatcctggaggagctgagcgcaatcactcaggaacaaatagagctgccagaggttccctccgagccccttcctgagaagatcccagaaaacgtccctgtcaaggccaggcccaggcaggcggagctggtggcagcttcgtaacgtggcctcgtcttgtgggactcacggggatgccccagggactgtggcccacagagagtttgggtcacggccagcccctgaccgggttccctggagcccagtgcgcacggtgctgagcagagctgcagccacgcaggcgcattgcaggaggactccagagcgtctcctggagaccttgagcctgaacgcactcaggcgccactggcctgctctcagtccggattaactctcgaccgagcccagcttctgccggttgtgggctcccccggtggccgaggcccaggcccaacgcctctggtgctgttcccctgcagtcccagccccgcgtggctcgcgctcgtctgtgaggaagacacctccagaccttggggtccccgcgcttcctcttgctcctcgctgctcccattagctggtgcaggcttccgttaaggggtccctcccttggcctggcttcccggcgcacctcagcttccctgctggtggggggatccccaggagaccagcatgtgctgaacctctctgtgcctctgcctccgcaccctagacacccacctccagtttgaaggtggcgggccaggggctttcttgctgaattgacgactccgagagccctgactcccgccttgccactcacggctctgtccactagggctcagccctgctgagaaaggacctccgatgcttgggagacgctgctccggcaggtgcagccccggaagtttgtccatgggggtccccgcggctggggctcatggaactgcgagacccgggaccctcctgccctgcgggtccccgagccaccagcagccaggactggaggctgtggggcatggcgtgacttctcgtgcacagggctggtttggttatgagacgatctcgctgggaccgcccctgcccgtggaaagccacaaggacaaagggagcggccacctcgacccccagacaggccggcccgtattaaagttggccctgcacgcccaaaaaaaaaaaaaaa

SEQ ID NO: 267 - DNA, 5377 bp, Homo sapiens
gggataatgctcccggagaaggattctgcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacct

SEQ ID NO: 268 - DNA, 2558 bp, Homo sapiens
gattgaacagcgcgcgtgggtttcccgcagccctggcgcagacgcgtgggctccgtggcgatgcggggtgttgcctgaggctccactgaagctatggcataatttgcagaatttgcacttcattacttttctgaaattcaaacaaattctgaaactgcacgagttctggctgagagctgtggatctgtgcattttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaaaaaaaaaaaaaaaa

SEQ ID NO: 269 - DNA, 2793 bp, Homo sapiens
cctgagcagccgctgggagacagacggcaaccaggttgcccctctttgctccagctagaaagacttgagttagacaagcagcagcacacgcctccctacctcatggcgacagaaaatggagcagttgagctgggaattcagaacccatcaacagacaaggcacctaaaggtcccacaggtgaaagacccctggctgcagggaaagaccctggccccccagacccaaagaaagctccggatccacccaccctgaagaaagatgccaaagcccctgcctcagagaaaggggatggtaccctggcccaaccctcaactagcagccaaggccccaaaggagagggtgacaggggcggggggcccgcggagggcagtgctgggcccccggcagccctgccccagcagactgcgacacctgagaccagcgtcaagaagcccaaggctgagcagggagcctcaggcagccaggatcctggaaagcccagggtgggcaagaaggcagcagagggccaagcagcagccaggaggggctcacctgcctttctgcatagccccagctgtcctgccatcatctccagttctgagaagctgctggccaagaagcccccaagcgaggcatcagagctcacctttgaaggggtgcccatgacccacagccccacggatcccaggccagccaaggcagaagaaggaaagaacatcctggcagagagccagaaggaagtgggagagaaaaccccaggccaggctggccaggctaagatgcaaggggacacctcgagggggattgagttccaggctgttccctcagagaaatccgaggtggggcaggccctctgtctcacagccagggaggaggactgcttccagattttggatgattgcccgccacctccggcccccttccctcaccgcatggtggagctgaggaccgggaatgtcagcagtgaattcagtatgaactccaaggaggcgctcggaggtggcaagtttggggcagtctgtacctgcatggagaaagccacaggcctcaagctggcagccaaggtcatcaagaaacagactcccaaagacaaggaaatggtgttgctggagattgaggtcatgaaccagctgaaccaccgcaatctgatccagctgtatgcagccatcgagactccgcatgagatcgtcctgttcatggagtacatcgagggcggagagctcttcgagaggattgtggatgaggactaccatctgaccgaggtggacaccatggtgtttgtcaggcagatctgtgacgggatcctcttcatgcacaagatgagggttttgcacctggacctcaagccagagaacatcctgtgtgtcaacaccaccgggcatttggtgaagatcattgactttggcctggcacggaggtataaccccaacgagaagctgaaggtgaactttgggaccccagagttcctgtcacctgaggtggtgaattatgaccaaatctccgataagacagacatgtggagtatgggggtgatcacctacatgctgctgagcggcctctcccccttcctgggagatgatgacacagagaccctaaacaacgttctatctggcaactggtactttgatgaagagacctttgaggccgtatcagacgaggccaaagactttgtctccaacctcatcgtcaaggaccagagggcccggatgaacgctgcccagtgtctcgcccatccctggctcaacaacctggcggagaaagccaaacgctgtaaccgacgccttaagtcccagatcttgcttaagaaatacctcatgaagaggcgctggaagaaaaacttcattgctgtcagcgctgccaaccgcttcaagaagatcagcagctcgggggcactgatggctctgggggtctgagccctgggcgcagctgaagcctggacgcagccacacagtggccggggctgaagccacacagcccagaaggccagaaaaggcagccagatccccagggcagcctcgttaggacaaggctgtgccaggctgggaggctcggggctccccacgcccccatgcagtgaccgcttccccgatgtgagccgcctcggagtgtggcctggatccatcctgctagcacctccccagacagggctccagcctgtcggccacaccccagactccaggcccccgttgaagccgctcccggttccctccccagctcctcgtctttgaactgccgccgccgtggtgacccctgctttgccccactgggagagtccttagcctgggcctcctcctagctggagtgccatggctggggggtctcagcatgtagggcttctgtggttgtggatgggaggctcctggtggggcagaaaggctgcaacgctgattcctaaggcccagctgccagggaagacagagcaggctttgtgagagaggacctccatgcccccgccacctccccactccagcagataaggccgagcccacaccatctggcccaggctggcccccacccaccttccttgcgaccaccaacacacaggaactctgtgtgagagagagggcgcccagcccaggcctggtggagggggaggggagaagccaagggacacaggagaccacccccgagcttgcctcagggccaagccggcccaacccaaccactcggggcccccatcttgggggtcacccatggcctcagatgatggggtcagcaggcccaggagaattaggaaggccatggggcagcctccagtctgctctcagcttgtgccttgtaaataaatgtacaggttggatgtggcctccttc

SEQ ID NO: 270 - DNA, 1832 bp, Homo sapiens
tcaatggtaaggcagtgctgtggaaatctgtctgtgtaactggggtgctatgcaggcctgtctgggtgactgtcagggacaactgtcctaccacaccaaggacacagccctgggggtgcttttcttcatagccaaagaagctgcaggaaacccaccctagtgggacaaagaccaatgcagggtcagtccccacagccaggtgatgcaaacaggctggacgtgggccgcctcccctccagcttgacttgtgacagggaaaccaatgcagcagcagcagggccaccagagtcctgtcctggggacaggcttccttccagcgggcggggagtgggtgctcctgccagaccagcctggcttccacggttccagagaccctgttctccctcagcccagtccccgcccccactccttggctttatgagttcattggctgaagtcacccggagacaatgctgagtgttccacccctgagtcgaagcccagcccagggcagcccagccagacgcctccggtagtgtaaatgaggacaatgcctgctggcccacatgacggggggatgtagacggcagcggcgccagtcgctcctggcaccatggacgatgccacagtcctaaggaagaagggttacatcgtaggcatcaatcttggcaagggttcctacgcaaaagtcaaatctgcctactctgagcgcctcaagttcaatgtggctgtcaagatcatcgaccgcaagaaaacacctactgactttgtggagagattccttcctcgggagatggacatcctggcaactgtcaaccacggctccatcatcaagacttacgagatctttgagacctctgacggacggatctacatcatcatggagcttggcgtccagggcgacctcctcgagttcatcaagtgccagggagccctgcatgaggacgtggcacgcaagatgttccgacagctctcctccgccgtcaagtactgccacgacctggacatcgtccaccgggacctcaagtgcgagaaccttctcctcgacaaggacttcaacatcaagctgtctgactttggcttctccaagcgctgcctgcgggacagcaatgggcgcatcatcctcagcaagaccttctgcgggtcggcagcatatgcagcccccgaggtgctgcagagcatcccctaccagcccaaggtgtatgacatctggagcctgggcgtgatcctgtacatcatggtctgcggctccatgccctatgacgactccgacatcaggaagatgctgcgtatccagaaggagcaccgtgtggacttcccgcgctccaagaacctgacctgcgagtgcaaggacctcatctaccgcatgctgcagcccgacgtcagccagcggctccacatcgatgagatcctcagccactcgtggctgcagccccccaagcccaaagccacgtcttctgcctccttcaagagggagggggagggcaagtaccgcgctgagtgcaaactggacaccaagacaggcttgaggcccgaccaccggcccgaccacaagcttggagccaaaacccagcaccggctgctggtggtgcccgagaacgagaacaggatggaggacaggctggccgagacctccagggccaaagaccatcacatctccggagctgaggtggggaaagcaagcacctagcatgacaatggccccgttgtgtgtggtgggggtcggggttggggggcatggtgcagtcggccttcacgtaaactaagtaggcaggtaggatctgaagaaggcacaggtgcaagtaaaattcgtcaattaaaccactattttgattacaaaaaaaaaaaaaaaa

SEQ ID NO: 271 - DNA, 3347 bp, Homo sapiens
agttgggtaccgggaggggcgaaggcgggcggcagaggcgatcagaagtttccaagggtcacttgtgtctcgtccgtgggaagaccgggggagcccagaaggccttggtgtggaattctgagagctgattcctgccttgtcttctccactgttcctggaggaatccgagaagagcagagcggagggagccccagacacggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccgccccaagcgcaagtttgagccaggcacccagcgcttcgagctgcacaagaaggcgcaggcgtcgctgaacgccgggctggacctgcggctggccgtgcagttgcccccgggcgaggacctgaacgactgggtggctgttcacgtggtggacttctttaaccgcgtcaacctcatctacggcaccatcagcgacggctgcacggagcagtcctgccccgtcatgtcggggggccccaagtatgagtaccgctggcaggatgagcataagttccggaagcccacggcactctccgcgcccaggtacatggacctgctgatggactggatcgaggcgcagatcaacaacgaggacctcttccccaccaacgttggcactccgtttcccaagaacttcctgcagacggtgcggaagatcctgtcgcggctgttccgcgtgttcgtgcacgtctacatccaccactttgaccgcatcgcgcagatgggctccgaggcccacgtgaacacctgctacaagcacttctactatttcgtcaaggagttcggcctcatcgacaccaaggagctggagccactgaaagaaatgaccgcccggatgtgccactgagagccccgcgggtctcccggtgcccgaaccgccgctggggcctcggagacttggaggaggacgctctggaaccatcatcccgcttctctccggcctgagcatctcagggagaccaggggccgagccgctgagcaggtgttggtcctcaggagctccaaccccggacggcagatgccttcctcagtctcgagcctcagtctcccgtctgggactaaaacgtgaactctgtaattctatgtgttactagcaaccggaaaagcccactgtgtttttaaaccacttccactttccaggaggctggatggcttccagggtcactccttgccctgggtggctcccaggctcctggaacttctgcctccacctcgctggggagcccccagggctgctgtggccacagccctgcctgggcctgtctctcaagggcacccagcttgctcggcctcctacatgtctcccgttggggaggcaagaggctgaggggcttccgagcccctgagagcggacatctcctcccgcaggcctttactccgcactccccactggcagccgctggtgtctcttcacacagaggcacaacctggacccaggcagcctctttcctccctccccaatctcttccatttttctacagatttttttttttttggtcatactagagacaggggtctcgctgaactcctggcctccagtgatcctccatcctcggcctcccaaagtgctggaatcacaggggtgagccaccgcacccagccctctctcttcctcaatgcactctgcttcttccgttcttccgaaacattcagctgactgtatccagggcttcctggactcctgggaccccacgtcctgcaccccggcttctgactcatttcctaagggcccctttgtgtatcataaagggtttgatttttatagtcacatttacaaccatcttgagatttttattttttttgaacggagtctcccactgtcgcccagactggagtccagtggcacaatctcggctcactgcatcctccacctcctgggttcaagtgattctcctgcttcagcctcccaagtagctgggattacaggtgtgcgccaccacgcccaggaaattattgtagttttagtagagacaagatttcaccatgttggccaggctggtctcaaactcctgacttcaggtgatccgcctaccttggcctccaaaagtgctgggattacaggcatgagctactgcacccggcctaaccaggctggagtgcagtggtgggatctcggctcactgcaagctccgcctcccagattcacgccattctcctgcctcagcctccccagcagctgggactacaggcacccaccgtcacacccggctaatttttttgtattttagtagagacagggtttcaccgtgttagccaggatggtcttgatctcctgaccttgtgatccaccagcctcagcctcccaaagtgctgggattacaggcgtgagccactgtgcccggccaagaatttttttatcgataacatagtgagctctctgcctcttcggaacgatgtccactttgcttatgatcaacccaagcaggactcttctctccctggacgcctctcccctggtctggaatcttccagttctgccagaattggcctttcccagatgctgcaaacttccagttgaacccctttttctgtgtggcccctggggctgcgagaccaaaatccatgagttctgtgtaccctagacctttggaaggtgagagcagggccctgagaaaaggcagccacctcctctccctggctgaacccctgccaccctactcctcaccagaattgtcagtggcctttcaccacagtggtccttcctgcctgagccctgcactgtcccagaccacacagaagtctggtcacctctgggcgcctgggatggtcaccgaagagaagcacgctgtccccgtctctcctggcttctgccagaaaatcgaacaagtgcaattaacacactgttactgccgaagcctgaaactcccaggacttgtccttgatccttccagaaaccaccaggtccggcacttggagccccccggagagggacctcccagccgagccctcaaagaactccatgaaatcaggaactgcttgatgaaatgtatctccttgtacctggaagatgaagcccaaacacccacacctctgtctcccccagggctcgggatgtctccagcagcccggccacgcagcttcccaggtgggctcggggaggtgggagcagggaccatctctgtcccctccaccctcactccatccacctcggagaccaccctcccccagccagatacggaataaaactacagacgcagacgtcggaaaaaaaaaaaaaaaaaa

SEQ ID NO: 272 - DNA, 1145 bp, Homo sapiens
ggcgtgtgggcggggcctagggagtgagcggggcgcatctcccgctaggagttcctagtaaagtggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaatatggtttcttactgtgtgttgcatttttgtgcccaaatacatagttttcatattaaaaagccttttctcttaaaaaaaaaaaaaaaaaaaaa

SEQ ID NO: 273 - DNA, 7996 bp, Homo sapiens
gcgacccgaggaggcggaagagcggcgccggcgacgtactgtaagacgatattactttaatcatcttcacatcagtatttatggaatagccacaggtgcctcatcctttagtaggagttaattatacatttactggccgagtaaacatctccgaatgtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgtactcctctgtctcgtctgaagcaagaagtagcaacattcagtcaaagggcagtatctgataccttgatgacaattaatcggatggagcaggcacgcacagaatacagaggagctctactgtggatgaaagatgtatcccaagagctggacccagacaccttaaagcaaatggaaaagtttagaaaagtacagatgcaagtgagaaatagcaaagcttcttttgacaagttaaagatggatgtttgtcagaaagtggatttacttggagctagtcgctgcaatatgctatctcattcgctcactacctaccagagaacactgcttggattctggaagaaaacagctcgaatgatgtcccaaattcatgaagcctgtattggctttcatccgtatgattttgtagctctcaagcaactacaagacacgccaagcaagattagtgaagacaataaagatgaacaaataggcggttttcttactgaacagctcaataagctagttttgtctgatgaggaagcaagctttgagagtgaacaagcaaacaaagatcacaatgaaaaacattctcaaatgagagaatttggagcacctcagttttctaactctgaaaatgttgcaaaagatctacctgtagattcattggaaggagaagattttgagaaggaattctcatttctgaacaacctcctaagttctggttcttcaagtactagtgaatttacccaagaatgccagactgcctttgggagccccagtgccagtctcacatcccaggagccttccatggggtctgagcccctcgctcattcttctcgattccttccttcacaactctttgaccttggctttcatgtggctggagcgttcaacaactgggtctcccaagaggaatcagaactttgtctttcacacactgataaccagccagtgccttcacagagtccaaagaaattaacaagatcccccaacaatggcaaccaagacatgtcagcctggttcaatctgtttgcagacttggatccactttcaaacccagatgctattggacactcagatgatgaacttcttaatgcttgactgaagttataatgtcacttcagtggccttgagacatcaattttgcaacgtatttccttcgtggaaaggatttagattgtaacccgcacacaaaagcacggtgtttgtgaatataacacctgtcagccaactttagacagatggtaaagaccacatttgaataagtacacatctttcatatcttggatttgcagctgttggtactatgtggaaaatattagaaacttctatgtggaaaatattagaaactacagagtttgcgatatttagatactgaaatttatgtcaaaataacggctaggaataattctgtcaatatggagttgagcttatttctttggaaacccttttaagttgccttgctggctgtgagaattttatatgtggataacaaagatagatagatagcatgtaaattgggttgtggtttggggtcagtttttaaatgaaatagtagcgaggaggattttctgttttggaaaacaccattagaaccagaccagctttgttttgggttagagagagtaagatttgagaactcagtttgctttaatgaaatcacagagaaacttggtacttgtttttcttcatttggaggctaaaatgtaatgttttttcattcatacaaaataatggacactccctaattccattattaaatcttgaaggggaagtagcaggataattaatttgctaagcccatcctctgcagaaacagaaaaatctatcttcccatctcctaaaactcagaatgcacagtaatacttaaggcttgtacaagtgtcttcagacccactttttcatacacttgctatatagtagtatgcagtatttatattattcctgaaaataaaatgaggggagaatattccctaagcaactggcaatagtattcctgaaatacctagaaatttctatctgaatgagggagacacttatgaacaccttatccttacatatatttgcatacttatctcatattttgtgacataattatttaacccagaatactttctggcagacatacagaaagctctgtgtgatcaataagggagtgtctcatttttctacttccctctttctgtgggtgacatgatctgaggttctatttgattactaagcaaaatctgttacccctacagggtttagaacctaagtattagagaggaaggctatttaatggaagttagtgtaagctgataaaaacgtagctaccgtacacacacatcaatcactcaatttcctgtccttttaaattgcccaccctttaattttgaagcaatttcccaagtgtgtgtttgttttatatttgtcatccagtccattgcatttccataagaagacattttgactggctgggtgcggtggctcacgcttgtaatcccagcactttgggaggctgaggcaggcggatcacgaggtcaggagatggagaccatcctggctaacatggtgaaaccccgtctctactaaaaatacaaaaaattagccaggcgtggtggcacgtgcctgtagtcccagctactccggaggctgaggcaggagaatggcgtgaacccgggaggcggagcttgcagtgagctgagatggcgccactgcactccagcctaggcaacagagcaagactccgtctcaaaaaaaaaaaaaaaaaaaaaagacattttaactaagttattcacagtagcttccatgtgctcttagttctattctaaacaggcttatttagaaaaggattgcttgtaatgtttgtcatggtacatagaaaacattggaccagagtaggtaaaatgcagtccatgtcccatccatagccatctacaatagtaactgcccacaggctctccagaaaactactacaatggccaagtacagtataggctggaaagaccttatctgaaggtcagaaacattgactcagaaaaaaggtatgaagtctttccataaaatcttttcacaatattactcctatttcttttagattttaatgagccattacttatctcttcagaagacttaagtcttcctttatactcagtgaaatttcccagaatgtaatactgtcactgttctgccaagttccaatcaccaagatcatgattacgaatcccaatctgaattctatacccatggtgactctgatgctctcaacttttgagtgcctcaaaaaatgctaaaactttggctgggcatggtggctcacgcctgtaatcccagcactttgggaggccatggcgggtggaacatttgagggcatgagttcgagaccagcctggccaacatggtgaaaccctgtctctactaaaaatacaaaaattagccaggtgtggaggtacatgcctgtaatcccagctactcaggaggctgaggcagaagaattgcttgaacccaggcggcagaggttgcagtgagtcgagattgcaccactacactccagcctgggcaacagagagcgactctctcaaaaaaaaaaaaaaaaaaaaaaaaaaaagctaactttatgtcttgagagtttgtaccatttttctttgtagtggtcaccttgctaatgcattagttctgagatatttatctccctcacatgtgtgcaaggaagtccctgttatcgaatacagatactttaacaagcagacaaagcagaaacccaaagtccatactaggaacaccctaaattttccaaaagcaaaagttctcccgaaatggagacatacaagggacttttattattctgttactagtttctataacatttcttctttcaacagagtatatgtttcccatttaacccagagcaacattaacttccttagcaagtccagttctaacttccaacaagtccaaccactgtttttgaagagcatatcagtaactatattaagatgaaggtaaccacattcgtattttctcaagattagttatttgaagctcagcagtttttgtggtcagaaagaaattttgctctattaaaccaatactgctaatataaaaaaccaccacactgaagaaacgagggaaaggacgggataagcacagaacagagaatgactggttgctttttgtctcaatctagataatccattcaataagaagtaaattaattatccttaaccaatggtaggctgagaacaaccctcaaaatagatattttttatgttaaatggggagaaatatctatactttatgttatactggataaaaatgtgttttaagtctaaaaaaaaccagacgagctaaactttgcctagtgtgtctacaaccattttttaggagacgcaggaataccagggcataataagatcagattggtgtaattttgtatgtttttgaaatccttcattaattgtagaaccttgatatgattagaaacaaactgtatttcaacaaacaggtttcagtatttgcacactgaaaaagtgttttgtattttaactataaatatttcacgtatctgtatagaccatctagaaatgtagaggtcttacagcattagaacgaaggaagtttacatgtgctctatctatttttctgagcctcttttaataaagattgcaagaaggcataaaacaagagtttgtttcctgaagtttttagtacaattattgttttcctattcaaaaacttgggttttacctcaagatcatagtattaggaaagtacattgagttgatacggacatgggagaacgaaaataaaaccagggcaattaatatccttgtaaggccaggcgcggtagctcacgcctatataacagcactttgggaggccaaggcaggcagatcacttgaagttgggagtttgagaccaccctggccaacatggtgaaaccccatctctatgaaaaatataaaaattagctgggcatggtggcagatgcctgtaatcccagctacttgggaggctgaggcaggagaatcgcttgaacccgggaggtggaggttgcagtgagctgagatcaggccatgcactccagcctgggtgacagagtgagactccgtctcaaaagaaaatccttgtgagatgaattcgttcttatttcatatacaaggggactatgtaagatatgggaaataatataatgtacgttatttatgtaaatactttcagtaacaaaaactaacaaatatcaaaaatctgagcctagacacaaacaattaaatataagccatagtatgtaacctgacttattgaaggcaggaataaaaagaagagagccagaattgattcagttatttttgtcttccatagtgttggcagggccctgcatttctctaccttgagcaatgaagcagtcccagaattttggaatatagaaattaggaaggaaaaacgaactttaaaatattaatttagtagaactgaaagtaatgcatttcatgcaacagtaaagtgcttaaacatggcaaagaaaactaagggacaagataagaaaaatggttggtaaagatgggtcacatccagaagcccaacataagctatttttccatctttttctgtaccatttaaaagactactaaagagttcaaaacaaactgtccttggcatttaaagtcaaaacatggttcttcactcagtggtgtaaattaactactcattggccaaagagtaaatacaaaaaggagatgaagttctgactggtgttgtgggtgagattttgcagtgtatgtttttacatttgtagtgtacgttttaaacttccggttttcttgctgcctcaacatctccacaaacaggctgtgagcacctggcccagtgtgatatgggtggcccctgccacaagtttcccttgctaccttgcccatgacctagtaacatttaaatgcaccagtgaaattctctttttcttgtgtgcttctccctgacccaaaggctcctgcccatgtcttaggcctctccgctccccacctgcttggctgagccccctcccatgtgaccccctctcagcatgcagtgactggtctctctaggacctgtgagtatattacaactttttttcctgtgtctctcctgtgatatctcttgtggctaaacctcactgaccataacctaaaaaaacacatacaaaaaacatgaaagaaaaagttgtttcttgagctggcctggacgaacggggagccaggggctcgaccctggctgttggaggcgcagtgaggcctggtctccggctgccagaccacgctgagcggagcgcgcggcaggctcgcctcagcgctgcggggaacgcgcgcgccgccgtccgcggtcgcccgtaggtgcctgcacgcgtcggggtcacggcctttggccgacaggagcgagaagactcaggagccgccccgcgccttcgatccggcgctgctggagttcctggtgtgcccgctctccaagaagccgctcagatatgaagcatcaacaaatgaattgattaatgaagagttgagaatagcttatccaatcattgatgggattcctaatattatcatattaggcagctaggatgacacatcaaagaagcaagaagtggagcagcgctagttcataatttaaaaaaataaaacagccaactcttcttagtaccatataccttttaaaacacagtggcaagtaataagcggaagagaagaatctttctgtctctttctacgttgactgttcttattccactggtttatttagcaggactgttccactcagcctctgtagaagaaaacttcccacagggctgcacttgcacagctagcctttgcttttacagcctgctcttgcctattaccataccggtgtatgtattcttccacctttggacctggatggttattaaactcttcatgcataactgatgcaactagagtcaatatgctgtatatattaatgatagctcttgggcatctatctctgaaagctcaaatggatggaatttagtttgtgggaaagaggctttgctttgagcatatcaggcttaggactgtggacggcttaagttgcagacgcttcttttattgtactcttgttctgcccgtgttttttgaaggctctgacataactgctttatcagaagaaacattttgacagtgtcttgttggagataaacatccctaattgacatgtgatgactacttcttattccattcatctaagagtcattgaaattttgttttctttgtttgtttagcttcaaggtctttggtagtcacatgttagggatgactgaaataattccaaaggagtgatgttggaatagtccctctaagggaaagaaatgcatttgaacgaatgtgatataaaaccacataatcaaatagaaatttcatgtacttacaaaaatttagtttgtaaaattaccttcatttctttgacattaaatgcttatattagcaataaagatgttgacactttctcataaaaaattt

SEQ ID NO: 274 - DNA, 822 bp, Homo sapiens
gttgctggggcttgcgtgggaggaaggtgactgtgaggaaggtgtgtgtccaccgagcacttggattcagcttcttcatttccaacatggaagaaacttacaccgactccctggaccctgagaagctattgcaatgcccctatgacaaaaaccatcaaatcagggcttgcaggtttccttatcatcttatcaagtgcagaaagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaatggaaatgcacagtaactgaatacctatctcatcaaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacagattgcttaaaaaaaaaaaa

SEQ ID NO: 275 - DNA, 3412 bp, Homo sapiens
ggctcgggcgggcggggggcggcggcgccagcggacaccggagcgggcaggagcagcggccgcggcgccgcagggaccagcgggcccaggctcggtctggggttcttgcagctggcaccagccctcccggccccggccgcccacccgccgcggggaagatgccggaacagagtaacgattaccgcgtggtggtgttcggggcgggcggcgtgggcaagagctcgctggtgctgcgcttcgtgaagggcacgttccgcgacacctacatccccaccatcgaggacacctaccggcaggtgatcagctgcgacaagagcgtgtgcacgctgcagatcacagacaccaccggcagccaccagttcccggccatgcagcgcctgtccatctccaagggccacgccttcatcctggtgttctccgtcaccagcaagcagtcgctggaggagctggggcccatctacaagctcatcgtgcagatcaagggcagcgtggaggacatccccgtgatgctcgtgggcaacaagtgcgatgagacgcagcgggaggtggacacgcgcgaggcgcaggcggtggcccaggagtggaagtgcgctttcatggagacctcggccaagatgaactacaacgtcaaggagctcttccaggagctgctgacgctggagacgcgccggaacatgagcctcaacatcgacggcaagcgctccgggaagcagaagaggacagaccgcgtcaagggcaaatgcaccctcatgtgagcccggaacgcccgcctgcccgccgcccacccccactgacccccgctgcctcccccaacaccgacaccctcctcggcctcctcctcttctctcatccttcctccgacacctcggctggggaaaccgaggccaccgcccccccctccgctgcccctgcccaccccgaggcagggctggggcttttcttcctcccctgctctctctccaccctcctgttctgtctgtaccctccaaaaccaagagccggaggtggcccccttgtcctgcagatgggaaaacaggatggggagctggcaagaggagctgcttgttcccaccaggaccagaggaggctgcgtttccccgtttccatctctttccctggggtgtccccagccagacctgcgcgtcctgtccctcacatttgatcactgtgaccttctgggggaggggggagttgaaaatgcacatcggcctcagatatttttttcttttttctcctatttggtgttaacatacacccaagcccacccggcccgtcgtgacctctgatctgtgcccactcctccggttccagacgcacctctctcctctgtcttcacagtggggtgtggggcccgtgggatgggcctcaggccaccaggcaataaccacagggcctgcagcagtgcccctgccagccccgaatcccacccccgggaccagccacatccacagcacaactgccccgctggagaggcaccatgggcgtggaggggcttcccggacaccgcccacccgggacccgcctcttccaccaagacagagacgttagcaacgcatggcgggtggggacctggggtgctcaggagggggtacccggggccccggccagagatacatcaattacacccccgtggggggacagccgatgggagccagcaccagcaggatccgagggcgccccggacagaggtctgccccacccacttcctccccaccacctgtgccccagagagcagggcctgcccgggaaggtggcgtcctggagtcgagtgtacctgcagccatgaggttctgggtgttttttgagagagtctgagtgacaccacactcgtgtgaccccacagggttgtgtccaacatacacggaagtggctatggaatggtgtatttgtgcaacctggggtgcgcggatgggtgacttgtatctaagtgcatctgcgtgtatacctgtgtgtgtctgtctgggatgatatgtttttgtggcagtctgtgtgtgtaatagtggtgtagggtatacagagaggtgggtagttgtagatacctgtgtgtggttgtcagcaagactggatatgtgtgaggtgtctgtgtgaatctttgtgcctgtatgagcatgactatattttggggagtgggtgatatggtttatctgagagcatttatctgtaaatatgtttgtcctgattgagggacacgatctgtgttccactctatagcaacatgactctagcaatgtgactttcggttccaaatctgtatcagtcagctactgctgtgtaacaaatgaccacaaatgtagcaaccagaaacaacacatgcttattatctcatagattctgtgggtcaagagcctgggtgcaggttggctgggtcctctacttgggatctcaggaggctgcaatcaaagcattcgccaggcagaggtctcatctgaaggcctgatcggggaaggatttgcttcttagaagctcatgtggttgttgcagcattcagttccttgctgttgcaagactgaaggcctcagttcctcgctggctgttggctggaagctgccctttgttctgtaccatgtgggtctctccacagcggggctcggagcatggcagctaagttagtgagggaaggtgagatggaggttttggtcttattgggtgtgaggaagcaacgtgtgtgtgtgcgcacgcccttttgtgcagtgagagagagagagagattgcacacatgtgtctctgtagtcatgtggccaggtgggactatgtaggtaacagattgctcgtgtctgatttggtacaagcatgtttgttttcctctgtgttcgtgtgagtgtttactcaacaaatgtttattggacacactcagagagagggagtgtgcacacgtgcgtgtgtgttgctatccagcacgtggaccgggctcccagaagagctggcattgtgtctgagcagagctgggtccccccaaaacttgggctggcccagggcccaccagcagctgatgttgcctcctctcctgtcctggcagtagcttctgggttctgaaggtgccggagagagtgaggctgggcaggggtctgcggccctttctcagggacacaccctgatagcacaatctccttggggccctgcccacctccaggcctctcccacctcaggccctgcccgaccctggggagagagggcatctgcaataggaggggacccgagcctgtcctggctgctggcccatcctgcctgggcatccctggtgctggggactgtgccaggccatgcttgctgtgactccgcccctgccccctctccccccgcatgtgggtgcccccactcccccatcgtggggtctgtgtagccttcgctctagacatagtcttcctgcaataaaaaagtggatcctgcattccccaccaaaaaaaaaaaaaaa

SEQ ID NO: 276 - DNA, 2906 bp, Homo sapiens
ctgcctggagagacatctggccaagttctggtgagcaggaaaaatgtctactcgttaccaccaagctgctagtgatagttacctggaacttctaaaagaggctaccaagcgagatctaaatctttcggatgaagacggcatgactcctactctcttggcagcctaccatgggaacttggaagccctagagataatctgcagtagaggaggggaccctgataggtgtgacatctggggaaacactcctctacattttgcagcctccaatggccatgcccactgcgtctcattcctggtcaactttggtgccaacatctttgccctggataatgacttacagactccactggatgctgctgccagcagggagcagaatgaatgtgttgctctcctggacaaggctgccactgcacagaacatcatgaaccccaagaaggtcaccaggctgaaggagcaggctcagaagaatgccaggaggcagatcaaagagtgtgagaggctccaggagaagcaccaaaataagatggcccacacctacagcaaggaggaatccgggactctctcttcttccaagggtaccttctccagatcatccccttcaaatgcttctgctcctggcacattcgggtcactatctaagggcattaaagacactttcaagatcaagttcaagaagaacaaagatacagcagaacaggtggggaaggaaggcagaagtgggcagaggaacgtgatggaagtgttcagagaggaagaggaagactcgttctcaggggacttcaaagagaagctccagttgtcagcagaggaggacggcagtgtgcaccatgaatccattctcaatcgtccaggtctaggaagtattgtttttagaaggaacaggatatcgagtcctgaagacatctcagatagcaagagagagtttggttttaaactgcccagtgaattgcttcaaagacaaggagcatcagaggctgatgagggtgcagctgatgaagagggagaggaaaacggcctcaaagatgatctgccgtgggatgacgatgaagtggagtgggaggaagatgtggtcgatgccacgcccctggaagtgttcttgctgtctcagcacctggaagaattcctgcctatcttcaagagagagcagattgatctagaagctctgctgctctgctctgatgaggaccttcagagcatacaaatgcagctgggtcccaggaagaaagttctgaatgctatcaacaggaggaagcaggtgcttcaacagcctgggcagctggtcgacaccagcctgtgatggagagttttggcctggagcattggggtgatgctgtggcccgctggcagcactccaggcggcaccccctctttacccaatgccagaccactgggaatggattctagggcatcggaaatgcctacctgagagagagacccaaactttactctgggaggtaggctatgcccatccaaataaatctccatgagaaacttgaggagacttcataacaagaatctggcatttctcttcagttatcttatatgtacatataattgtttttgtggttgttttgttttgttttgttttgttttttggagatgaaggtctcagtctcttacccaggctagggtgcagtggtatgatcatagttcactgtattctcaacctcctgggctcaaatgatctcctcccacctcagcctcccaagtagctgagactacaggttcacaccccccacacctggcttattttgtatgttttagtagaggtggggtcttgccacattgcccaggctggtctcaaactcctggcctcaagcaatcctcccacctcagcctcctaaagcactgggattacaggtgtgaaccaccgtacccagcctatctttttgatacttttgaataaagaaagggtcatatgcatgacaggaaaatgaaagaaacttcctttacttttctatctctggatttaaaattataatctcatcacattatcctgctgcttgctttccgatctgtgtaacctgggaattccaattctttttctctcctgagatctatgactttgcctagtggtagagactagagttctttcctggcctgcggcttgatgcccaacttaaatgcatctaaccctttaacaaatgtgtacatgtttacaagtaatggaaatgcgtctataatactcctgcctgagaatagagacagagtggtggtggggagagtgaagaaagagatagaatacaggtggtacctgttgtggactgaattgcgtcaaattcatatgttggagctctaacccctaatgtgactgtaattggaaataagacctttaaagaagtgattaaggttaaatgaagtcataagaatgcaaccctaatcctgtaggactggtgtcctttttttccctttttttttttttttttgagatggagccttgctctgtcactcatgctggagtgcagtggcgtgatctcagctcactgcaacccccgcctcccaggttcgagcacttttcatgcctcagcctcctgagtagctgggattacaggcgtgcaccacaacgcctggctaagtttttgtatttttagtagaggcggggtttcaccatgttggccaggctggtctcaaactcctgacctcaggtgatccacctgcctcggcctcccagagtgctgggattacaggcatgagccactgcacctggcctaggactggtgtcctaagaagaggaagagacacttaggtggaaggcacacagagaggccacgtgaggacacagtgagaaggtggccgtctgcaagccgaggagggggcctcaggagaaaccaaccctgcaatcaccttgatcttgggctttcagcccccaaaggtgtgagaaaataaacttcggttgataaactgct

SEQ ID NO: 277 - DNA, 2987 bp, Homo sapiens
gggagaccagggttgtttaccagcaggacagagcccgggcgcaggcggcggatggagcggaacggctaggggtcttgagaagcaatggccacagaagcccctgtgaatatagcaccacctgagtgtagcactgttgtcagcacagcagttgacagcctcatttggcagccaaactcactaaatatgcacatgataaggcccaagtccgccaagggacggacaagaccgagtctgcagaaatcccagggcgtggaggtgtgcgctcatcatataccatctccgcctccagccattccctatgagttgccaagcagccaaaaaccaggagcctgtgcacccaaatctccaaaccagggagcttctgatgagatccctgagctgcagcagcaagtacccactggggcttcctcttctctcaataagtatccagtccttccttccatcaacagaaagaacctggaggaggaggctgtggaaaccgttgccaaaaaggccagctcactgcaactgagcagtatccgggctctttaccaagacgagacgggcaccatgaagacaagtgaagaagattccagagctcgagcttgtgccgtggagaggaaattcatcgtccgaaccaagaaacagggctcttccagggctggaaatctggaggaaccatcggaccaagaaccaaggttgctgcttgctgttagatcaccaacaggccaaaggtttgtacgccatttccggccaacagatgatttgcaaaccattgttgctgtggccgaacagaaaaacaaaacctcctaccgacactgcagcattgaaacaatggaggtgcccaggaggcgattttctgacctcaccaaatctctgcaagagtgcagaatcccccacaagtctgtgctgggcatctcactggaagatggggaagggtggccctgagtccacagccacccagctgaggtcctgggtctctgagcaaaggagcatgcttgggcgttgtggcctcttaggcagcctgtttcaagtgccatgtggacctggtgcagctgggaagcttgggactctcgtctgcactgcgtgtcctctgaagcagtgaagtctgtgcctatgccgagcgcgctaagaagtctcccttccagctgttccattctctccaccaccagcgtaactggcaagttaccaaggttgttcctgaaacagcagtgatcatgacttctcctttccagagttttgggtccttctgaattaatggtccttttcgaacaccggcttgcctttacagtgaactgtgattctctcgaagccaatgctttcctgtctgtatttgatgcaggattaaacacttcccagagaggattctagtctggtaaataaccacagtgtaggaactatctaactggcatttgtgtttcttgcgagtattttgaagaaacaggccgttgaccccatctttggaagtagccctttaccatgcatggtcagtttcttagggatttactatttgtgtgaggtggcatctaagggaagaatgggttttcttccccaaaacatcagcatttctaaaatagtcctaaagcttgaaagtaagttgcttccatgagcatggattacccagtagctactttttaatagagactgactaggtttacaacttctgggagctactctgtgggctgaattcttccaaaaccgagaaaagccagtgcagtctgatttcttttgcttttgtcagtaatggaatcttttgtttttaaaatgtacaaacctataagtttaaacaggtttgtactgacaacctccttggcttatttgggggtggagcaattgttttattccccagtttcagtgcgttgcccacttcaaacatggtgtgtcctttggagctgtgacagaggtgcctgttctgacttagaacctctggaggaggaggggggtgccttggtctcgtgttactttgctgtgcctgtgctgagagaccatgtgcccgagcatctggttgaccggcatgaagtacatcagcctgtcttagcctgagctgctttgaagaccatggggtcttgtgtttccaacttcgaagtgctgatgtggacagtttgccaatgttctcttctattgcaagttcagccagactccatgactcatctgatcccttttatggccaaatcatccttcagagtagggaacactcagacattctgtgcatgttgttcccccaaagcatggtcatcacaaagtcctgagttctggtgtgtgctcccgcctcctgggtatacagagagaaggcaggaatcaggagttccagaagcatatacatgtggctaccccagcaacaagcgcatcctgtgctcagataagctgcatggttgggagtgttttttctcgcacgttgaggcttagtggagatgggcaccactgccatttgctcagaagaaggctggtctggtcctaactgcatcccacactgcccagatcattctagaataggttatttctgaatgttttatagaatttcttaataccatcctggtttggtcagccattcctttgattggaaaggtcagctggggccagtggtgcctcaggcaggcccacacaactggccacctcttcccgttaatgaccacagcagacagaatttgagcccagcacctaaaagtacaggaatttcacttcccaccaggacttgagcacataactctatgtctgatctaggaggctgggggaagagcctcccataaaatcacacctactctgtggtaagaataaaatcccacccacctgggacttggtaatttctccaaacaggaaagctttagaaaacttgagtgaaatggagcaagcttgaaggagttagaatcttctgtgcttagggtttgctgctgctggtgagcttagaattttggggttgggaaaaagtggaaggcataagcatagaaatattttaggatattttaggatatgtgaataaagctagactcaaaccaaaaaaaaaaaaaaaa

SEQ ID NO: 278 - DNA, 3506 bp, Homo sapiens
acacgcctcctaccaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaagtaagcaatggcctcagttttgcttctgttttggatgaacaccaccacatagggcctgaatgtgaaagaagaccctctatttgtctgttccggggcagcctggtagtaaaacactgttgaatgggccacagtttcagcagaccatcaggtgaatgggaccagtctctcttcttccaaaatatcagaagttaaacacttggaacggagatttggccaagatgacccatttacaggctggactcagtccagagactatagagaaagctcgcctggaactgaatgaaaaccccgatgttttacatcaggatattcagcaagtcagggacatgatcatcaccaggcctgacattggatttttacgtacagatgatgccttcatcctgagatttctccgagccaggaagtttcaccaagcggatgcctttagactcctggctcagtatttccagtaccgccagctaaacctggacatgttcaaaaacttcaaggcagatgatcccggcattaagagggctctgatcgatgggttccccggggtgctggaaaaccgagaccattacggcaggaagattcttttgctgtttgcagccaattgggatcagagtaggaactccttcacagacatccttcgtgccatcctgctgtcattggaagtcctaatcgaagatccggagcttcagataaatggcttcattttaattatagactggagtaatttttccttcaaacaagcctccaaactgacaccttcaatccttaaactggccattgaagggttgcaggacagctttcctgcccgctttggaggagtccactttgtcaaccagccctggtacattcatgccctctacacactcatcaagccatttcttaaagacaagaccaggaaacggattttcctgcatggaaacaatttaaacagccttcaccagctaatacaccctgaatttttgccctctgaatttggaggaactcttcctccttatgacatgggaacttgggcccggacgttactcggtcccgactacagcgatgaaaatgactatactcacacatcctataatgcaatgcacgtgaagcatacgtcctcgaatctggagagagaatgctcacccaagctgatgaaaagatctcagtctgtggtagaagctgggaccctgaaacatgaggagaagggagagaatgagaacacccagccactcctggctctggactgaaccctgagtcaccccaatgctcctgcacactggccttcagtggtatcagccacccaggaagcacatgcacaactgacccatgcagacacgtgtgttctgcttgacacaaggtcctccactcctgaacccctgcagtgactgtcaccagccatcggtctgagcagccaaagttggacaaagacttgagagatgctttttttttcccccagtgaggggactggaggatgatgcaaggcatttatgtaaaaaagattctccctcctttcatatttattgtagtaaattgaaaaaataaagactaaatttgatggacacactgcattaggacaagaatttttctgaggtatcacacagggaccctctccagtttttgaaaattaagtgcatttccaagtaaatgtatcagagttaaactgtacagacaccactgtcaagtttcatgtagtacaaagccctgagacaatagtatctccagtaatttccattcttactgaattatttcctttgacctcatcaccagcatcgaattgttcagcctaagagcatgttctcataggtctgggtatttgcaaagtttgcttattttgatgatatcctgcaaaaaattattttgatgtcacatctcttgtcaggtcactagctgactgtcatgagctgacgttaaaggaagacacatggacgtgaaatacgattatttcatctgagcaatgtgagttaccacaggcagctcaaaagcccattagtgcagcatgtgtctgcagaggagatgtctcatgaaaatcacatgtcagtgattaatgaatccattccagttgcctcaactgggtcactacagcaaagaaaagtgctatcaaaccatttacccttgcccccacaaccctcctgcaaccattaaagatgtggagaaagaccatggttgttgctgagagggtaaatattcaatcatggagcatgacccatatggatggctaaatatgcaagtactgaagtaagagaagactagaaatgcaggatgaaatgtcaaaggtcattttatttacctagtctccttagaaatggagtccccaactactcattcaaaagaaatcagacataaaataaacagacatcatatatgatatccttacttgtgccatgttttccaagaccagtgcatatttttagacatctcttattcgcccagccatctgcatgacatgggtatttattagtattaccagttggtgctcaaagtcaaacaaaaatattttagttaataatgggcagtaaaatatgattttacattattttaaatatttgggagagttaatttgttagctaaataattcaagggaaagagattattcaactggtcataatcacccctgataatattattactaatcttaattatttattacatcatctctttctcaatggatctaatgttttaattttttcccctattggtagagaacaataacagaagtaatttttatattatacacttggagaaataaagttgaaacagaattaaaaatatttctcaaacaactgtatcacaatataaattaaactaattcatttttgtgtagacatacgaaatcacaaaaataataacactgaaataattctaccaatgcagtgatggaaacacttttcttatgtaccaagacatagataggtaagagaaataaagaattgaagtgaattagaaaatccattttattgcttgggtttaaaatagttgtgggatacaagtatttacaatgctattggagtcaattattgacaacactttgcaacagtaataccatttctagcttttcaattggcaatacttagaaccttactgtagtgacctgattttaaataccatattatatttactaagttaagagctagtttttactctcttccataatttcattacatgaatgtaagatgatggctcaaaaatgacgacttatagtttgaatttatgtgtatgcaatatacatatgagaaccaaattcaacaagtgacatgaatgttactacatgaacattgaattgtattgcccttgtcagttatttcctctgttcaataaatactgaaggtcacaaacacctttttacttttcaaaaaaaaaaaaaaaa

SEQ ID NO: 279 - DNA, 3817 bp, Homo sapiens
tttttttccccgcctcccaaccgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaaatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaaacttgtttc

SEQ ID NO: 280 - DNA, 2406 bp, Homo sapiens
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagcattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggcaaaaaaa

SEQ ID NO: 281 - DNA, 1766 bp, Homo sapiens
gtgaggtgctgcgggaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacgggcagcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggaggctgtgcggctggacgccgaggtgttcatggccctgctgcggcggctgcttccgcacgtgcacaagcacctgcagcaggtgggcgtcggacccctgctgtacctgcccgagtggttcctgtgcctcttcgcccgctccctgcccttccccacagtgctgcgtgtctgggatgccttcctcagtgagggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccagcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccagagggcaccaggaataaaatcttcttgaacagaaaaaaaaaaaaaaaaaaaaaaaaaaaaaaaaaaaaaaaaaaaaaaaaaaaaaaaaaaaaaa

SEQ ID NO: 282 - DNA, 2711 bp, Homo sapiens
agctggacgagcggcagcagctgggcgagtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagagggcttttctttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagctttgcagttactgtgaactattgtctcttggaggaagttttttgtttaagaattgatatgattaaactgaattaatatatgcaa

We claim:

1. A method of treating type I diabetes in a subject comprising administering to the subject an inhibitory nucleic acid specific for an mRNA that encodes FAT10.

2. The method of claim 1, wherein the inhibitory nucleic acid is of an siRNA.

3. The method of claim 1, wherein the inhibitory nucleic acid is an shRNA.

4. The method of claim 1, wherein the inhibitory nucleic acid is an antisense RNA molecule.

5. The method of claim 1, wherein the inhibitory nucleic acid is a nucleic acid that encodes an siRNA.

6. The method of claim 1, wherein the inhibitory nucleic acid is a nucleic acid that encodes an shRNA.

7. The method of claim 1, wherein the inhibitory nucleic acid is a nucleic acid that encodes and antisense RNA molecule.

* * * * *